United States Patent 12,642,819 (COMPOSITIONS AND METHODS FOR TREATING INFLAMMATORY BOWEL DISEASE) - sequence listing, part 39

SEQ ID NO: 13 - DNA, 4609219 bp, Bacteroides uniformis (residues 3,072,815-4,609,219 of 4,609,219)
  modified_base (1563664)..(1563759): a, c, t, g, unknown or other
  modified_base (2408456)..(2408551): a, c, t, g, unknown or other
  modified_base (2445651)..(2445749): a, c, t, g, unknown or other
  modified_base (4497132)..(4497229): a, c, t, g, unknown or other
  modified_base (4509652)..(4509661): a, c, t, g, unknown or other
  modified_base (4509911)..(4510012): a, c, t, g, unknown or other
  modified_base (4511081)..(4511090): a, c, t, g, unknown or other
  modified_base (4514342)..(4514351): a, c, t, g, unknown or other
  modified_base (4528516)..(4529058): a, c, t, g, unknown or other
  modified_base (4545795)..(4545917): a, c, t, g, unknown or other
  modified_base (4548795)..(4548828): a, c, t, g, unknown or other
  modified_base (4549558)..(4549586): a, c, t, g, unknown or other
  modified_base (4583762)..(4583895): a, c, t, g, unknown or other
  modified_base (4595233)..(4595335): a, c, t, g, unknown or other
  modified_base (4598204)..(4598213): a, c, t, g, unknown or other
  modified_base (4598465)..(4598514): a, c, t, g, unknown or other
gcgtacgcgctgctgtacgaccgatacaccacacgagaaagcccggtacccacatagaacctgtcgaaccaatgagaggaagtggaaccgccttccttggccgcaatcaaatccatataccggccccaaaccatgtgggtaggataaatatccgcattataaacagtaattccctgtacaacgcgttccgttccgtccggcatggtaataaaccaccttccgtccgccgccgtcttgtttactgtgacatactgcaaccattccgccttgtttccctggaaattctcatatcccagcacattgacggactgataatttacaccgtcccggtaagcaccttccgcctgtggattggaaccgcccttttccttataataagaaaccgtatcacgcatccccagcgcatttgtaaggcctgtcactttctggtaattgtttgttccatatccgcaaactccctgcgaatcggtattaccgtatttaaagaaatgcagattacccacatccttgtgcatctcccagtcgaacagctggaaacctttgcccctgttctgggcgtatttgactgcctggctctgtgaaatagttcctacacttgaaacaccactgacagaacgcagcacatcatcaatcagataggcttcataaacaccgcccaggcattccgtatgctctacccagtccggctcgatcgcttccacactttccgatgttgtgagtaaaacgaaatcgaaggccgccgaattaaggaaagtaaaggccagtttcgtagcccctacaggaacggcacaaaacagatacataccattgataaaaccgttcgcatttgaaacgctgatccgacttactattttcccggcatcatctataaatacagcaccgtaaagagtagaagcaaaaccgggaaaacgaacctgcttgtaatcccggacgtccaccagggcgaacgatccggattcgtattcattcttcgcctcttcaatggttgtgtaatccgtattcttacgaatcccgatcccttccgtcacatccagttcctcgcgggtaaatcttatactggtgtaccctgctgctgccggcgcatcctcattacttgaaataaaaccgtaaaggcactgattcagcacgtccgttactcccttgtaccagtaatgaggctcatatatgtaaacttcaccttccgatccggttaatactgcatccgtggcgttctccacgctgtcactatccgcgtatttatttcggttctcatcatgaagcgggtaacaggtcatttcaccctccgccgtctttttagccagaatacaacgtcttttcgacaacacttccaatatatgggaagacggggtaaattcagtattatagtcatatccggtagagttatccagattcgtaatcttttccccgtctcctaccgtctgatctatttttataccgacaaactgcggctgaatgatattcagttccgggaaatgtgcacaggtggcggcgtactcttcatccgacatggactgggtgagccggtacgtacctaccaggcggcacgtctgcacgtttcccccgtcttcatcaacgccgcccattgtcataagcctgcgaagcaaattaccgttcccgtccatatctataccggtaattcgtagatagctggtcgcactgcattgctgtaataacgtgttccagtcgatcaggctacagttatcaatcacaaggcgcgtgatatttgccgtaccttccagctgcagccctgcattggttagtttgttcaggtaccggagttcgagcgtctgcaaagttccgggaaggacgcaaacggccagaggcgcaccgccggcaaatgtcacaccggtaagggatgtatcaccggccaggaaggtttcaagtttggtattacttgaaaggtccataccggtaaaggaagaagatttaagtccggatatgtcgagttttcgaagattacggcaattacccaccagaagggcgttaaatgtcgtctgtccggcctcacaactaacattcagttcacgcaaggccgtgcagttgttcaggttcaacgtgccgacaatggcgtgggctacatccgtcagatcaagcccgcgaatacggcttgcaccgtagaaatattgcggatcgtttacaattaaatccgtgtccattgtcagttccaccacagccccggccgtttctgcaagtaccgcgctttggtgcggtgttccggacgtgtacccgtacccgtaataataccgttcggaggccgtaatccgaattttccggttatcgctgccgaacttgtatccgaaataagccgcgaagctgtcacgacggtaagtaccggccacatactgactatccaaaagggcgaaacggttctgaatggtataagtacggtgcgcataacggcttccctgcaaggcatacagataattataataactggttccgctgccggttgtcaccccttcggtaagcggaaggatatatttatattccgaatccttgttataaatccgctcgcaccagttgcccatttgttcctcgttaaatacttgcaggacatattcaaggctcatattgctacgcaaggtttccgccacttcacgcaatttgtccggacaagaccgtaccagttcccataaaacggaatcatggccggcaaaagcataactaccgatactatcgtcaaaactttcgtgggtaatggtatattcgtatttcagtaccgaatcattacgcacaccgaacagcgtgtccatatcgtaaggaaggaaataccagatcagagagtcccaagtcgccagcatcatgttttttgcccggttatccacagccataaagtaatcggtaatcagataccatgcaaacgggctgtcattaccgaaatactggttatattccgccaggaacttggcgggatcatccttacatgaatcgatccagttccaaagccttgtaactgccgccttgtcgtcctcgtgtgcatccgcccaggtagtgtccgccttgaaacgaaattccagcgcatcatcaaaagaagacatgtcggtagtcccgaacagacaaagggcctcggagttgttcaggaactccagacagatacatttgttacgctgcccgttcagggccgcttcgtcgttgaatccttcaattccttcaaaaccgtaaatgatcgcactttccgacttctcattattgaaattgtattttcccagataagtattcgcaccggtgccgtcgttgtcataaaacaggtccatagggaaaccgtccacgcctatacgtacgtcatattcccccttatatgcagcctgcggcggtgtcagccacccgcacctcttccaaacgtcgttcacaatacgcaccgcaccggtattatgtgtaccggaagaatcggaaaagtccgctttcaaacagaatatactgatcggccgtgctcccggtttgaaactgtattcaagggacggcacatccacgccgttaacttccagcgtggtaccgtatttttccaggcgcaagaaataaagacggtaattcttacgcggataagtggtggatgatgtaccctgtattcttagaccgacattccttgctacaaaatcgtactccttaccctgcgggctataaaaatagatatcgaccggtacctcgaatttcttgttattggtggcgttgacaaggttcacatcgccgacaattcgcataaccgcctttccctgggcgcgtaacttgtctatgtcgatatccgtaccgttgtcccccgtaacatcattcttttcaaataacaggaccatttcgtccgacgtagtccggtctaccatgtaattgttcaattcttcatcatccgtaagcgcacggttataaatacggaaattcctgatctccacatccgccgtatcactgaacaaacggatgttcaccggttccgcctgcagtaatccttcggtagccccatactgcaccgctccgcaacggattccgtttacataaagttccagcaaccgcttaccggccttggccccgacaataaaggccattttcaggttcatatcacttgcaaacttcgtacttacttccgtaccgccggaaacacgcataagggcctgctccgttgtcatctggaaaccgatatcgccggccatacagtccagtatcaccccctgccggtccgttaccgacgaacaaagaatttccatttcataggtagccccggtagtggttgcatccgtggagaacggccggtacccgatttcaatcttcgcgcctcccgtaagtttcagggcgtcacccgtccagccgttgctgctccagtcgaaaccagaaaatgtcgtatgtatgtcgccataatcccaggctcccggatcggattcgctgttgctccgcccggctgccgaaagtttcagtacaagcccggcggtagtttcctgcaagtcgatcccgctttccgttacgtcgatataaaacgggtattccgtggcccccgtcttaaatttcatagtgatctcgccctgctccgtaaaacggttggtatatgtctgcgtagtacgggccacactgacagactgcgttttcaccccgtcccggtaaacgtccatttgagccggcgttgcgtcaggatcataagccacaaagtcaaattttacctgttcgtactgccccgcttccaagcgcggaacaagatggtcctccgtaaaaatacggccgtccggaaaactcatcatcgtgccgatgaacggtgccgatcctccggatttcagaatatcaatatagatactttcagactttaacacgagatcggcggaagcctccatttcggcaaccatttgaacggtattccggccggtcacaagcgaagagggggacaaactgaaactgccgtttgtcgttcccgatcttgtaatggtgtgcgcgttctgttgccggccgttcagataaagcgtgacgacctttgttccggaaccgctcacggcataagggatattaatcgtgtcggccagggtataaccgcctgcggctatggccccggccagattgtaagagctggtaagggaaaggctgacaaccttcacggatgtaaacgcctgtcgggtctgtttcttgccggtagtcggatcggttgtggttgccactacgtaaatatcggtattcccaacaagcaagtaacttgaaaggtccagttcgtaactgcctttggaaacatcgctgaccgtctgggaatacatggtagttgttccacgcctgatcgtaacggtgatatccgccttttgcccggtagattcccccttttcatcccccgtggtgtattggtgatcgtatgtataagtaagacgggcgtttccgccttccttgattatggcgttatctacagccgcattcaagacaattttagtagccaccgtttcgccggaacctccaccggaaccggccgggatatccacggcggtaatttccgcgccgcttttgttctggaaagacagacggacggatgtttcatcctcgcttacctccgcatttacgttaaacagcgtggaagcgtccacctcgttaaaacgggcggttactaccttgttttctaccggattggtggaatcggcggacaaagtctcgtccacttccaggatatccacgtttacattcacattaccggccgcgtccggcgtctgcttctcgccgtttaccgttacgctctttaccgttcctttgccgccgaactcttcccagctcgcctcctggtcccaggcatccagggcggttccggtaaactggtacgtctcccatttgccgagcgatgtttcaaaggtgatgacacgcccccggccgcgccacttctccggtaccgcggcaatggcggaagccagggtatagaaaccttccgtaagcggcacactgccggttacattataggtattcccgccgcctgaaccgccgctgccgaaatcctcccacttttcgacattctcaaaatccgtgtccggattgcctttaaattgtttcgtcacccagccgtcggcagtgaggaaagaaaggatcacgccgtttttccggacatcgtcaatcttccccgccgttttcaatgctgcaaacacccccgacagatcactataaacgctgccggcgttcaagaggttgtttacattggtaaaggtggaagacagacgcccggcagtttcctgcaactcctgtttcatttcgtcacggtctgcctgcaacgtgcttatgtcctcggaacaactgctaatatcctgggacagacttttcagctttccccaaagggaaccgtcttcactctgtgaaccgtcttcgctgccgatacgggcgttgatatcggccagcaatgcggccagcgaatcactgtctttaagcccgtccagaaaagcaagaatttcgttaaagttgtcgattgcctgcgaagcgttgttgccgacaagccggtcgatacgtagagaaacggcgtcgatagccttctgcaaggctgcatcggcggcaatgcgggcggcttcctccgcctcgatttccttaccctgggaaaccagtttcaggtgttcgttcaagaagccaagaaccgccgccaccatttggttggtaacgctttccgcgtcctccgcggtttcaatgactataataagatcatcgatatactcctgtgttgccatatagatacattaattaaattgtttactgaactctttggaatgaacccgcggtttccggtagccgctttccgtgatttctcccgtccagttggactccttctcggcaaacgtgagctttaacgtcacgttctgcggcgcgtccggacggacacggtaagaaaactcttccgccgaaggaattaccttgatctcttcccggccgtaacctgccaggtagacatcatcggaggaaagcaggtcaagaagaaagcgtatttcctgcgggcgtttgaatcccgtcttaaccgttacggcttcctgtatctccgtacgtatgcgatccgaataataatcatcggtaatttcatcgtaacgccggaaaacagcgtcttcgtcttcatccatgccgggagttacgctcgcctcgccttccagggaaaacacctcgtaaaccccgtaactgttcaggaaccggagccggtaacgctcgcggaccgtcgggctttgctcgatcccgatccggagagcgaacgtttcaccgctatacacgtcaaaaaggttggccagtaccccgtaatcggtaaagaatttaagtcttacggcctccaggttcaaggcgtagaaattccctgccgtgcctggtactgcaaggctttgtccggtaagaagttccgttattttcagctcgtgctccggatagatgaaacagagcgggtaaagttccgtctcgcgcatcgttatacgccagtcattgctccgggtggtaaagaagaaattgcaggattcattcaagaacttcaaagaaaagatgttattaccttcttcatgcaatttcttaaaagcccgtttggatataccgccacgccaggcagtaacaaccaaagtggccgtttcttcctcctcattttgaagggtgatcgtggcgaccgccttgttataccgtttatcggaaaggcttatcaacatctcggaactgtccgttaacgggggaatatcaacaaaaagcgtttccaggacctccgcgatattcaccttgaaacttccattaccgttaccggtaaatatggaacgcataaattcaaagttcacgaaatacattatattgtaagtcgccatagaagtagtttctaccgaaagataaacagggtttccggtaaaggcgttttccgtcggatcaatgtttgctgtcaaactcataattcaaaggtgttaacgatgaatattccgttaaactcactcttattttcaagtccggaaaggaaacgatcacgctgatccgtgggagacgtcaggaacttgtaaaagtccgagagccgccccgcatggttttccctccaaagcttataaagctccgtcacctgtgaagatgacggggcaaggatgatattattctgcttttccatgctgcaaaagttgggtttatcaaaggaagaataaaggacgggatcagctaagcaccctcgatgcgacaaaccttacctggtattcgacttcttccgtttcgtaacaaaaatagttggccgcgccggaacgctcgtttacctcgatttcaacctctatcttacatttgtaagttttttctatgatgttatcctgtgcggtgggcggattttttaatatatcctcatccgttgacggcgtaacatacccgtcatatatcgtattcgatacacggcaaccgtacacagcatacatccagtgataacggtaataatcttcccaatattccacccttccggcctgtacactctgcaaattggaagaatatacgacccacacgtaggaagcaccgccccacacgggaatgccctgttcattatccagattatagggaccgatcagacgcagggaacgcaacgtaatgtttaccggtaccagtttacccgcaggaagcgaataggaaaggccgtccagaagcatgtactgcccccgcagggctaccggggtcaagacatccattttcataagctggtgaaccggtaaaagggtgtttgtgtccacctggttaaaagagtgccttaatacggcgtcatacttctgccagaacttggcaaacagaccgtcttcaaactggaataaaagcgatatcgtatgtttgctgccgtcttttaacgtaatttctccgccgtccggagcgtatggtaaaatagaaccgaaggaataatccgtactttccgtaacggcctttgtaaaagcgaaagcgaaggaaagcggcgtctcctccttttccgaatcctcttcatcatcggaagaggttttcaggtaggtataacggtgcacatacccggccaggtaatacggggaaagaaggccgttcggggcaaaatccataaacacgcattcatcatcgctcgccagctcctcgtcctctacgttttccgtcttccggtcccagttaaagaaactggatgatgataacgtatgcttcttgttgcccgaatcccatttgtaccagttgccggtggtcttctcgtagttcagccacacggaggcctgggaaggatcgaaacggcttacacggataaccattttttcgttccccttgatatagtcctcgtaccgttccaccgaaggcgcggcaccggtaaaagacgttttggccgataactttatctgacgggccgtttcataattgataaggggttccgccgtcagattccgggacagatcaacggcaggttcatcttccattatatcccggatcagtcttaaagtggccgttttcgtatcggaagagacattataaaccagtccgaaacgtacatacagcgcgtttaaaaagtcctcaatcgtacaatccggcattaaatcggcataattgaggatacccgtcacgcaacagtcggcggcattgttcaggattaccaggctggaaagttccttgtccgtcttaaaaggattttcggttatagtataaccaaattctgaaaatataaagtccaggacacggtgcacgtataagaagggggccacgccgtacccttccggtaaactcgtttcggtcggggtatcatttatcagtagtgtttccgtccttgcctgatagcataaggcatattcaccgtttgaatccaaagtgatacggtttatgtattgcgggtaatacgtgccgtccttggaatcatttttgactactatttgaaatatggcaaaatcttcatgggaatccgtgaagaaccagtttatagaggacataagaccgctaacggtaccgccgcttatgctgggtaatgtgatcgagttcagtttctttgctttccaggcgctgtaggcttccgaattgtcaaaaccgatatttaaagtaattccttccgtcctgccggcggaaacgatatttatctttccggtacgtttatacaccccgtccaataccgtacatgtctgatcttcattcatcggttttacacccatgtcgagccggtgggcaaaaccggttatccctgcattgttggcagtgacgggaaccgtgaccggtacggtttgtgatccccggtcgttcatgacgggggatttctcgtcgatctgtacggtaaagtcaccccctaagtccagataacctttgttcgtcttaatctttagcataatgattacttattttccgcgtgtaaaggtgtcgcgggcgttatctatagtttctttggccttctccaaatcctggtaaacgatataggcctttatcaatttgatagcctcacaggaggcgcgaagctcctttgccgcttccaggaactcccggtaggaagaatcacctgcaggggaagtcacgtaaccgccttcataatattcacccggattctgtggtaacgggttggcactggtacgctgccgcctgatcgcttcgatagtgctaacggcgtcgatcactttaggattattcatttccggctgtggtaccacatattcccccttatgaaccacgccggccacttcataacgtccgccgggaccggtgtaaccaccttcataatacccaccaccggaagaaccggaaacaacacgttcagccgtggcggtcttgctgccggtggtgtttttcaaggacatgtttttaatcctgtcccgttctgccttggccgatgcaagctgggccacaccggtagccgcaagcattactgcagcaacggttccggcaatcggcccgaggtccgcgtacgccttcataatcgaaacggccgtatctgctatgatctgggaacacttgatagcaaagtttacatccgcgtacttcttttgaatctccagtttcttattttccttctcttcttccagggcggcagtatcttcaccgttgttctcggcttcctgtatgagaacatcgtattttgcttccacctggtcgatttcggcttgttgaatggcttccaccatggaagaggaaagaccggaatagtagtcaaagtattttttagcgttattcatctgcatttgcagctttttacgctggtatgtcttttcatctattaattcctgatcgtgcagattctttaacagggccagttcattctggtattcctgtgcccatgatacgccgatctgggattgaatctggtataaactattctggtactcaaattcaagctggctaatttcctgctgtttctgtttctccaaaccaacggtagaaattcccgcctgcctcgctatctcaattatggcattataagtcgtttctacatcctgaacctgtttccggtgtgcttcctgcataccggttattcctaccggaacggaagttatttcacgtactttttgagcaatggccgcccgatcacgcaataacttcatttcagactcacgcacggcgtcggccgcttccgtcgctgtttctatacgtttctgtttaccggtaatttccaaagcggcaatatcattctggtaagtacggtttatctccagaagttctgcggcgtgctccgcttcaacttccagcatataggcgtcggcggcttcctgcgtgatactttggtttaataccgctttttccatggtgtccttctggacattgtaataggcggtttcaatctttaaccgttcgtcccgtttctcctgtaccagttttatacgggcgtcctcctgcttgccggtttccgtaaaaatggccgtctgtgcttctgtttcgagcttgtggatttcatcgagtaatttctttttattagccggcgtttttgcttccagcttctggagtgcgtcgatacgttcccggtaatagcgaaggttttccgccgtcccttcgagaatatactgggcttccgtcttattttccttctcccggttctgtttgattagaagcatacgtttttcgtgctcgatctccagaggttttaacgtggcgtccgtttccgtatttttatactccccggcttccgccttctttttgaccttccccagttcgtttaaacgttttatttcggtgtcgatacgttctatttccttgtttttcttggcgatattcgcttcgctgtcttccgcccactgttcctgaacctttttcttttcggcctccagtttctttatgagggatgtttcagtatttatattttctttattggttccggttaatgaagtggccgtcgcctctgtttttaagatatcattattgatctgggcgattgctgattctataccggccaaatccttctgtgttgtctgtagggctttcaactggttagcctctttttccgtaccaaataaacggcttattttagcggtaagactgttccggttatatcctgacaatgtattttgctggcgggtgtcccagtaagcgtcgctttgctctgattcctggctttcaagattcctttttttcttgtacaattcttccagttcctcctggtaagctttcaacttgatttgtttttccaaggaaactaaatattgatctatagcctccttgttgttgtttatgagcctgccttcttcattcaattccgcattataatccggtatcagttcttttaattcagcgagcctttgtttacgggtgtagttggaaaggttctcgtcattaatagcagctacaagagtttttatttttgcttcctggctggcatattcttcattcactttctttacgacttcctggtgggccttcatcgccgccgaagcctgttccgtcttctttgcaagctggtagatagcaacaccggctgccacgagtaacgcgagcagggccgtatatggattcttcaaaagttcgatcctcattaaccgaagggcggcggtacatcttttaatattcaggtgcagcaatgcctgggccgccgcataagccagagtagccgcccggctgatataaagctgtacggcgtgcgctttctctgcaacgaccgaagcaagggtcgccgttttaaaacgggcgtgccacatggtagcgattttcagtcctccatagtaagaaaccaaataagcggtaacggtataagtgacaacaccccatttattaaacatgtcgatcataccgcccacaccttccaccataagcgtaacaaggtctattaaatcccgaagaataccctttgattcatagaaacgtaaaactaccccttcgatagttgaacttaatgtattgagggaaccttgtacattatcacccatttcttccgccatggcattaaatccctcttcggctcctgttactgcatcacggagatttaaaacggtatcagtaccatttaaaaaggtattaaatgcggcaaccgaacgtttatccgttaaatccagtgccttattaaggtctattccttcactgttcagctttttcagcccctttacaaggtcttctaagttatctacaggaccaccaagggcaagtgcaagtttaccgctaccgtcagccaagttaagcaaaatattacgtgttgccgtcgctgccgatgaagcgtcgaaaccgctgtttgccaaagcccccaaaagggcggtcgtttcctcgatcgtgaatccgaaagaattagcaaccggcccaacaatagacattgccgtatttaagtactcgaagcttaaagcggatgcgttacatcccatagtcatagtagaaacagcccgttccgtatcttccgcatcaaggttgaaaatacgcaatgttgcaccggcaagcgtagcagccgaggcaagatcagtgtccacagccttagcgaatttcagcacggaaggcgtcatcgctttaatatcctctttaaaaaatcccagcttggcaagctctatctgaagttccgttacctgtgcggccgtataagaagtagtagcacccagccggcgcgcttcatctgttaaatccttgatactctttttcgtggttcccagaatagcggccaaagtactgtttttcttctcgaactctataatagtactgatcgcatcccttagcccgccgacaatctgtccggttatcattgcgccgatagtgacaaacacaccggccagaaccgtttttatcttattcagggaaagaagggaaccgccgaaaccttccgcctttttcgtggcctgcccgtatgctttctcaacttctttcagttccttctccagggcggcatatttttccggctgcaaggatttcaccgtatcgcgaagctctttccgcaaggcgtttgccttccttgccagctggttggcactcatggtggttttatccagccgtttctcacattcggcaatcttcttgttattctcgccgatcgtcttattattttctttcagttgctcatcaagccttttccattgtttaccgccagctttcccggtggcgattaaatcggtcatagccttttttatctccttattgctatcccggagctccttgttcttttctgaaagattatgtatttccttctgcgcatcggaggcgttcagggttaacacccattcgatatagtcaggttttaattttgccataagagtaaattttataaggcaaaattatcctggtgtaaagtggcggaaaaggacacaaaaaaagcccgtagaaccattctacaggcttattatactaagaagaaagtattttatctcttaaaggtaaaatccgaaggatcaaaacattctttatccttaattgttgcccgatctatcatccagcaaatgtaccaggttagaggaaccgatataagaggcgtcacgataaaggaaagaaaggcaaaagcaagccacccggataaagtagccggtttatgcttacatcctacgaaaaaaaatattaccaggaaaaagccgatcaaaaataaaatatcttcgtatgtcatacaatcatcgttagttctttaccgatatctttaatagtatttactattagggcctcccgttcttgtgagggcttttttattccacttatatattgagacataaggctttgacttattcccatacgtcgagccaccgcagaagcatttagttccgggtgagaaataaaaatccgatataagaaagtttcttccttcttatcttgaatagctaaacaatcattcatagggtctaaaaatatgcagctataccaatttcatataaaaactccggtgcaaggtcggcaccattggcccattcaatagtagcacgggttaaaccatattgaacaaatttttccttatccaataactccccgaaaacctcacctgtaagataaggttccaaatttacgatctttttactcccgtcgctgaaagtaacaagaagctcgtaattcctaatataatccacatctataacccgtaacataagcgtttattttaatggttcaattttatctattttttcccctttttgggccttttcccaaagagaaagtatttctgcctcgtgcaagttaatccactcatttacttttgcaataactttagctggagcctgaccgtctacaatccgatccaatacgctaatagaacattcataatcaccataagtaaaatgaatatgtggcggattatgatctttccaatagaggaatataataataccgaagaatctacaaatttcaggcataaactttgttttattggttactgaaacaaagataggtaataaaatcattacctacaaatatttaggtattaattttattacctattttagcgaactggcaaacatttcttttatcctttcccttacataatcctgatattcatatttaatcttcccgagtgtgtcatgatatagaatcccgtatatctgccggttataaatctggtaattaccgtgtttcttcatatccaggaagcgggtatataatggaaggttagaatgtgcgattactccttcgccgtccggaatgaccgaataattcgggttctgtagtgcggccattaatgcaccggatcgcccttgtatgatctccccggttccctgtactttcctacgctcacggcctttctggtaaatccgtttggtagcgatatccagttgggcttgaaatatgtcctgtattccacgcccgatccggtcggtaaaaaaatccgttttaaaattctcggccattcagttagaatcttgttttaaatgagaaagccaggctccaccctgcaaacgtccggtaaaagccggattccggaagagtggaaaggctggttaaatccagttccttagtgacagggcaaccggtggcagaatcttctatcagcatttgtttgatacgttccataaccggctgtacctcttcgatagtctcataagcccctttccgttggggatcgtacttgctcataaggaaaataacgcataaattattttccctcacattgtcagccgaaaggctggcacccgttcccgacgggatcagaataaagagcaccggacattcttctttagatagtccctgtatcgtcttactcatttcctcgtcaatggtaacgggcagcatcttctttatttcaggaatacgtttttgtacgccttcccagtattcacggtaaacctttatatctatcatattgtcaatccctggtaacgtttcgcctcccattcacggcgggtaacaagccccggaagaatcttaccgcccccgtatatccactttttaaactctgccggtatggatggctcatacgcatccgctctgatcttcttataaagcgttgatttcttgaattttccgatacctacattaaagcaaaagcttactaccgcgtcaaactggtactgtcccaaatgaaggggaagcgcgtttacctggttttctaccgccctgatatccgattcaaagaaagcgtcggcccgggcctcggtgataacatctcccggttttacgccggttgtgtgaccgtaaccgatcgtacatactcccgcggcacatacatacgctttcaggcgtagcccctcaaattgcttaatcttgttttttgttcctgttgttgttctcatttcttgttacgtttttggtgtaaatactcaaacttacatttatacagataaagtaatacatcccaaaagggtgtatcgtccacctccttcttattaccgaacacgccggaagccgccacttcaaagactattccggtccagccggttttatcgtccgccttccggtcctcggatgccaacttctgaaataatatccgaaagtcaatatcttcaccaccaatataaaccggtccggaaagaaccatttcccaaacagcggaaaagaagtttaccgcatgaatggcaagcaaggaaggaacggccggcatcttctccgggtccttgtaccggtaaagctttaatgtgatatcctggaagatttcatttatagccggttcgtctttttctgtcgccgcctgcttgctttgctgcaacaaatccaggcaatcacaaaagttaccgaaagtaagaccgttcagcatgtcaccgacaccatgccagctcccaaaatcctgcatcaggttacgcccggttttcagaatgggcgtaacgatccgctcgccctccttaccggtcgtataagagaaaaagccgtccagcttttccagttggccgtccagctcccggatgatctcacgccggtacatggtgtaatccgctttcatgcccagaaggaaagaaagccattttacgcggaactgtccggggctgatcgtaccgcggttcatcagtaccgacaatataagaaactgccggtactgctcactgctgacttcatccaggcatgaaggaacctccgccgtcttactattatatgtaaacttctccatgtccggacattaaaaggttattcctttggattgtacggtaacacccggtatatagtaatccaccgtttccgactgcgcatccagttccctgatgatatcctgcaatacatccaggtaagccgccgcgtcctgctccagactgttagcaaccgattgccgggcctctttttccgcccgcaatttatcccgtacggttgtgctctgctgtacctgtacgattccattgggtagaacttccaccggtaaacgttcaacggccttttttatggtgagaagtgcaagcgggcggcgtacatactccagcaatttctccgttaaaacggtatcgccttcaatcagtttattataacggttccgggtgataacaggtattatctgcccgtcctggacttcccggatcataggaataagcaccagaaaaagccggtgactgccgatattgtaatattcatcgaacgtttccttattctggattagaagccggtttatagcctttttcttaatgccgttcatccagaaatcaaacttttcgcggtccattaactccaccaacgcgtctacggcttcataagccaggttccggatattctcttcatccttgaactcctgtaaggcggtcatacccgtttcattctctccaaggtgtttgccacgtccggccgttccgtgttgtgcgtctaaagtgggaatgacctttaaccaggtaaacattgccaccgcctgctgcatcagccgcaaagtttccgccatgccgtccggttccgtaccgtccgcatgatcttcacggtaatacttatctaccgcgtctatgggttccgttccgatgatagcctgtaaatcccgaatacccagcggtaagataggttcccacttggtaaaatcaagatcattatcgatcaatcccagaacacggactatttcaccggcaccgtcaccgcctttattaaataacttcgtcatttgctcggtctctttttaatgtatatggtttccaattatcaaaatcctttgtgaaattgtttatttcatcgtagaactccttataaaagcgggccagcccggtatctatcgttatacaggtctgctccgtgcgcggattggtgttcacattggccgagctttctattacaaaatcaaaagcgttaccaaaaccggccattactttagcatgattacggaagatgcagacacgtgatccgaaacgttccgccaccttctttaggtataaataaacatccgcgtaggaaccttgaaagatttcacctacataaaaatccgcgtgccctatgtcttttctctccagccatttctccacctccttaacatcggtaattgccatacaccaggtagaaatcagaacatattccaccggttgttgcttcacgatcacacgaagataagtaaggctgtcaacgtccccatgactgatacagtgataagacgcccctttctcaaaatgccagggcaaacactcttccaggtgcagctccgattttatccgccggtcaaaatgaacgtttttcgtccggcgggcctttatatgcttatccggggtgttatcggcccggttctcttccggttgccggtcgcttaccggttcttccggcacatcttccggtttcggtgtaaaaaacagactacgcattttctttcatacggttagagggtgaaacgttctgttccgcttccactatggtacgataaagccctactttcgttgcggtacccggaaagttggcattaatatactgctgtaacggcttacaaaggatcatgtccggaatagccgtttcagaagcgttatacactttcaggctgtataatttctccgatccggaagaaagtttgttttctataatcagatttgaaagtaccggatcaagaccgaagccggaagtggcggcagcgtccgccttattggatatcttaatctgggcgtccacataatcctttatcttcttatccagtggttccaccgtccagccctcaaagttattcgcttccggattccagaatttggtcgtgtgcatgtattttccggcgttctgccttccggtaatgttggaggcgaatttctccatagcttcgtccttgaaatcttccagcatctgggccgtgtatttctcgcccgtacgctcgcaaacctgttttatacgtgcttccgcgcggtcccagtaagactgcggcgattcgatatgcagggaaatggccgaagcgttttcgttataggcgatcaggatagcggccagaccgccggcaagctccagccagtcaagcgcacccaaaaaacgcggtgtactcataaaatccttgcaaaaggaatagatattataatatttcacagaaaccggatatttgaacgggtgggccggatcaaagaccgggtaacggtaagtataggccggatcaggataaggaaagtcgcccacaagtacttcctgcggttcatcctcgccgtcgggaggatataccaggcgggccttctggtagggaatatgttccagccgtaccaaacgcccgggattgcctacacgcggcgcacggttccggacaaactttataaaaaagccctgcatgtgtgttaagtctacgagtgagcggtgaagaaccgtcgtgtaatcccacgactccaggtcggcggttatttccggatcgagtttccaacgccggtaaaaacggttattctcttcgtcgatcgcatcctcatacagccgcgggccttctccccactgtaaaccggctattttacccataataccttcaccggcgtagaatttatccagtaaacgcatgacctcgcccggcatgtcgttattgtcacccatgggaacgataaaggtaccgtttacgctgatctttcgcgaaaagaaagccccccgccggtttaactggatgctggaaggttcccaacctttaccgcggccaccgatagaaaaggagatcaaacccttgtcggtgccggtatctataattccaaagttgccacttcgtcttatttccataatcttaaatcgttattcttttcccgttgaactccattaccagacattcccagcaattcagcggccggcccgttgtggtgtccgtcaggaatagtttatagcttgaattttcgatgctttcatccgtcgcctttttcctcaaacgggcggcagtaagtatcaccatgtcgccgccgtcccgcgtctgacggttccatttccggaacttgatagaaaaggtacccccggaaatggtaatccgcttcatctgttctaccgctacataaaggtttattttttccatagccggcggataaagtttttaatactggcccagttatcatgtaccaagcagaaggatagaaagaaaaacatgaattttaggaacgtccataggctacacccgtttgtagtcttttctttttcctggctttgttgcttaacgtcggatttacgggtaacggctgtttccgtttgactggtagtttccttatgatcccggagggaactgctttgattctttccagttcttttttcagtttttcggttactgaaatcaatttctttaattcttccgaggctgtcgtagtcgatacggatatgcgtactatcttcccggtaaacgtcaagtacgtgctcctcatggctcgaatctctccgcgcaagttcaataactccgtcagtagttgtttgtttttcttctccagttgcttctgtaaccgtttttcgtgtaacagagcgaggagaacgacaaccgtaaaaacaagctgcaaaacaaataagaataagtaggtgtacgattccatgtctcataattgattttagttattagtgtcgaaagtgatagatttacggttcaggcaatttttcaccccgcaaagaaacggtttcatgatatccattacgcgggcgttctgcctgatatccttttccatttcgttacatttctgctggagttcccggtactggctctctacatcgtcgatccgctgtttcaattccttacggtcattcttcatatcctcaatcagttcctggtaaacctcctgtactgacttcatggcgtcagcttccgcctgtttacgggtataccggagagtgaataaccaagtcaggccacccgtgcaaagagctgtaataatcgctgtaattatcgtttccgtcatattagtagagttgaaaatgttacattatagtccggacgatacatacatgcgtcaaataacccgccacgatcccggccaggtctgccagaatatccttccagtcccatttattacagggggacatttcatccccgtattccttacccagtgaagcacccagggcaaagggaacaccataatcacccaacagggcacatatagcgtaattaattccgaaatgcttccatttgtccgttcctattttcataatttgaatcattggttactgcaaaggtgggaagaacggaaacggacgaaaaggacataaaaaagagtgccgggaaccaccccggcacaaacaaaccctaacctgggacttaaacccaacggctgccttttcagccggtatgctaaattgttaatattaaggattagacaacttttcgatgtcttttttcatcatacgtaataattgaatccttcttaacacctcatttgttggtgtactttcatctcctttctctattaggaaatcgattaggtcctcaataacttcgatgtaacaagcggaaaccggttccgtcttagtttgccactgtgtcaaaatctcggcactttcatctgttatatgtgcgccgtttacttctatatctttcataacaaatctttcattaaacgtttttaatcggtgtagtctctaaggtagtgaaatcaattattccggcctgccggtatatcccgagggcgactttcctaaaccgttcgtaattacgtctgtcaatgggcgataactgccacctcttcatgtctttcatcagatccggtatattattggcactattatacagacagttgtttttaccgtactcgtgatgaagtgatacagactgaaaatcaccggagaaaacaaccaaccgcaaacgttcaagttcaaggaaagcaaactcattgttaaccttctccaccttataggctcttaattcaatggaaggcgtgccgtattcacgtctaacgaaaaataggatatcaggattatttgtattcatttggcacctccttttaagtcttctaatttaatatgtgaaatacttgttatactttccagtaccccgtcgcatacacttttaacccttaatccgcgggaaccgtctttcttgggtaaattcaggtgataatacgggcgattcctccagaatgtaatccggaaaatccagccacgaactttaaaagtagcattgcttattttataatcaatctgtatcagatcacccggtttaaatttactttcttgtagaaacatttcctgtatttcttccttttccttctttatttcctcaatccttttatcattgttttgtaattgagtaagtaacacttgctgatattcagtatatatcattcggcacctcctttcttttctatctggggacgctctgaaaacctatatattcttttaacccggtaaatgaaaaaataggctacaggcttgtcacagccgttattatgtgttttagtgtcctgatctatatgaataaacccgctaccggaagatattttcagcggcattgttttagggtatttctcgttcagctcctttacctttgcttccagttcagttttaaaagcatcaaaggaaattttatcagggcaaagcgtattaccaaactggtttgcaaactctgccatttcagcacattttcggttctgtggcttatattcgttaagctctataaaataagatatcattttcggcctcctttcctcgctttcttggcacgacacacacatataactgcaccaatgacagccggtggatagataaaagtaagacagaaacaagcgatagcagataagtaataagccccagaagttgaacaaacagtacattcatgtttcggttcctgaaaataacgatgttggattgtgtttacgtccgtgctaccagtacggaacgaaggtacatagcttgtaccggattgaaattcatttttcataacggtgttaattttgactattttacatgggaaaggcggttaccatttcccctaattcgtcaaaattaacaccgcaaaccgtccgaagatcgggttataagtttagggaaaggcaaccgccttgtattaaacaagcacttatcgggcataaaaaaagcccgttatttattcgagccaataaccgagactcaccggaccgcaccagcggtgttaactttgacaggggcaaatgtcggcattaaattctgaacaaaaaaaaaaaaacgttaataaaagtttattaggaaagaaagtttctcgactctacgattcgttacttcgtaacaaaaaacgcccacctgattaagggtgagcgttacacactataattaatattctatttgtcttttaaattaattccctcttttatctgttcatcagaagttacctttttacaaagaatatagtgataaacagggtctttgctcattccttgtgtaggtgtaaccggataagccagtattagttcccaacccaatttagccaaatagttaacggcgtctatcattgaattaaaattcatcttttcaccgttttcatctactaaaaaacgagcatttggtgttgcccattttgccttctggccgaaatctacttctatttttacttttgtaccggttatatttccagtacccacgatttcacaataagccttatacggttcttgtgcaatggctgccattgttagtatggccaatacaataactaaaaaaaatcttttcatatcagtaacttaaaattagtgtgtactttagtttgtaccaccccgtaagtcctgacggtatatatgcagtgtaattttgacgattgcaaaagtacttaaatatatacatttataaaaaatattaccccaaaatcaatcaaaaatgaaaggcaaccgccccaaaatacacggtaattcacccaaaaatgggcaaaaaatgaaacaaaaacacataaaaaacgcactttttcgcgtaaaattttggtctaaatgcagataaacgactgaaaaacagtcaaaagccgaaaaaaaattcaaaaactaaaaaaatgacaccttccgaagaccgagccgctcagaagtcggaaagcagttgccctccccctaaaaggtgaaatatgacctctcccggaggggtacccgtaacctggtaacacaaaaaacgccggaaaaccaattttccagcgttacaaggcaattaccttttatgcctgttctctatccattgatccacaaacgagtcggcctgcagcgtccgcttgcctcgtactaaagctatccagccggggcgcatcagtaagtatttgaaagcgtcggagaaattggtggataacatcggtagtttttttggtgccagcttttcggacttcttcactttgaacactactttagaattaccccggtatttgatttcagcctttgccttttctacagaactaaccatttctttacagttcaccgcatcaaccaacaggataggcaggttcttgttggtaccgcccataatctcctgcatgaagtcgtattccgcatcctgccggataactgcctgtttgcggctctttaggtttacgatccagccggtacggtttccgctgccgtctttttctatggcgtctttgatcttacccgcgtaatcctccttctgtttttcaaagttattacctgcacggtcatagtacaaatccagttctttgtattcgtggttctggaaaaaagaaaggaactggtcggcgatctcccggaaccagcccggcggtatctcaaaaaagttcttatgtacccggtaataagcaccgtccggctgaccgatcaccaaagaaagcatattaccgaagtccataccgccttcaatcgctttatcatggtgcaggtaccggagttcccgcgagctgtaagcggcttctccagacatggtaccgttataatacttatgtccttcaccaaacaacacatagaaacgtaaatccctgcgaagaccgggacgcatacccaccaccgactttttaaattcgtgaagctccagcgtaccattatacaaccgctttaaatactctatcgtaagtatctcaacattagcgaatgaagaagcgttaagaaagaacgtctgcccttttctcaacttcaacaaagcccgatcgtaatattcaatatcccgcttcaaacgtttcagtttcaagggggaaggcctgttctttctttgttcccgtaaaagggaaattatcaagtcattacgtacacttgccgcctgcactattttaatgatccgttccgggtccatttgcttgacataccggaaaaaccagtcgtactcgttttcgtcgatatccggcatatcggtagtaatggttattcccaggaacaaatgggaatgtccgtaagtgatcgcatcaccgcgaagaataggcatagcgcggtttactttcatttccttatcgtacttcgcttcatcataaaacagatgtattacagactttccggcaagcaatgaagggttatccagtgatcccatgaaaataacacatccgttccagaagctataaacatgcttgtaatcatctacgataaccgaacatttacgccgccaggattcaggcgggcgggtatcttttacatagtgtaccccttcgatcaggcccataagttgccagcccttctgtacggccggcattatattatcttccaggttactgtaggtattggcaacaaaagcgaacgcaccgccgggcatttcttccacacaccgggcggaacgcctggcttgtataacggtagatttagccataccgcggccgtcaatagatacaaggatagtagtatcgatccagtccgtcagaacctggattatatgaccgtattttatttctacatcatcggcgttactcaccttcgttatcttccccgaactctttgatatcatacaacatacgttttttcagatcaaaagctttaatacgcgcatcctcttttatattatcacgtacaataacaggaatttccggtatcgcgtcgataaactcttccaattccttacggtcgatttcaggaacacccagatccttacggctggtagtataaataaccgtgcttttctgtgaaagcagttcctccggtatttcggtctgttggtccttataacatccgcgaagttccgccgccagtttcagaaggttcttagcctcctttacattacccataagaaagacggtattcgcccaattttcggccttttccgcatacaggttggcgaaagcctgcggacgtacgttatcctgtgtataaaagaaattgagactgtcggcgtacacctggcgggccatccagtccgaaaggccgtaaggctccgactttaaaaggcggatgataccggcctttgtcaccaacttgccatttatacgcatacgggcacgaaggccccgtaccatttccataaggctgtaatattccctttcatcgggcgcgagtgcttccagcgtaccggtagaaagaatcctttgaatctggttgatatccaccttgtcaaagtctattcgtgagggcttaattaaattcgtcgtcatccatttgttcgattaaacgttcaaaagtatgtcttttccgtacggcctccagctgttttatagcttccacgtttccaccttccgccgcttcatggagttttatttcaggggcggcacgtgctacgagaatcccttcccggatcagaaagttaacagaagttcccaccgtttccgcatcccggacaaaaagcccgacatcttccggagaaagccccagggaaacggctatgtctttcgaagaataccctaaagaagacaaacgccgtacatcctctttttgctgcgcatccaggtaaatactatctaccaccgttaaatcgttcatacgcatcttttattcgtttctgtgccgtgaaataataaatttcgtcctgttccattaaaacaaagttccggccgctttcaatggatgccacggccgtagtaccggaaccgccgaaagtgtccaggatcaaatcgcccggctttgtactgtcttcaatcagtttacggatcaacgccaccggtttttgcgtgggatgaaccttttcaccttctaccagtttagcaccggacgcaaaagaacggatattatctattatgtttgtggcaccaatagaaacaccctttccacaatgaaacaaaataagttcatgtataaaggcgtaatgattacccggccccgactgtttattccaaacgagcatgtttgacgcgcctaaatacaagtcaaacaacggataataaaaagcatatccgcgccagtccgtaaaaaaatacacgcaagcaccgggtttcttcacccggttaaactcctgaaacaaatcccggtaaaagggtttacagatagacaaatctttaaaactgcctttctgcccgttatgtgtcattcccaggaaataaggcggatcggttattatacaatctacagaattgtccggaacacgtttcaacgcctccaggcaatcctcgttataaatttggtttgttatcattggaaagttgtttaagccggctttcttctttttctatccggagggttaatgtcttgagctggtgccccagctccgagcggtcgcaagggtgagaaaaacggccccggtccttcatgatccgttgccgttttcctgtcaaagtggcaataagttcaactactttttttttcgcgcctcgatttcttcctctatggctttctttgtagtctcccacttttggatcattgcaagggcactcgctttcttcttctcatcatccccggcctgttccagtttcgccttattctttgaaaggttggcacgagcgttattcaatgccttttgtatgtcgatatccgaaagattctcgacacccttacggacggacaaactttttaccttctcacatttacccaaaatctttccgttttcccggtaatattccagttcgtcccacatttcgcggttagtaatgaaattttccacaaccgcctgcgcttcctgtgctgtagaaagtgaactgacatcatccggcgtaacctccagacgggcgaaagcctccttatacttcccgtatgcggtgaacatgtcggaaacaagtattttcagaatgtcgggacaatccggagagttcaggaaggtaaatttctcgcggaaacgtatcattttggttacggtttccggagccgccttgtatcgtttctccgcctcttccagttcctcttccagctcttccacacggtcggcattttcatccatggaaagaaccttatcccggaaatcggacgaaacgagttcttccacgctgacgccgaaagattcggcaagttccagcagcaaatcatcgctgtattttaccggcatttttggaggttcctgtcgggcgggttccatttttaccgcggccggctgtttagagttgcgccggatcgtcttaaattcacgttcggaaagcccggccagcttccgtagttcctctaaaagaatggccttcatcgtttccgtttctccctgccggcgaaatgacttctttagcatacggttgataccgtatttctcgtacagttccacgccttgaataaagttacgcggaccggccagataggtaataatttcctgtttcatactatataaaatttgatgatacaaagaaaaaaaaggcaattacccccaaaaaggacaaagggtggccgggcatgtgctgccggtcaccctttgaatgatatgaaagccgtttacttacgcctcataacggctttgttcaatccatttcatagcctccgaaccgtcgttaaacgcccgcaatgtcagttgggaaccttcggaagcggtaaacgtcttaccgcctttcagaaggaaattaccgcctttttccactgttggcgcaacgcccgaacatcccataagggtaattaccgatccatgacttccaccggtaacaccggctattttggccgcacctgcggaaagctggtactgcccgtctgtctggtaatctatatctgtggcaccggcttccactacggccaccggttcttccagggtgtcggtaccccggtaaatggcgatatcatcccccttgctgatctgggtgaaagtaagttcgttcgtattcgattcattggaaccggtataagaaacggataacttagacgggttacagggcgttccgatcagatcggcaggctttccgctacaataacggagaacaacgatacattttttagacagccagtttgtcttaaactcgcgaatctcctgttcgttaccgggatgattgaacttaacggaaggcgtataaccttcggcgtcggtttccccgtcactgttggaactgatttcagcggtaccgggtgtcaggtaaataccgatcgcataacgccccgccttcatcacgatatcctcctcgataaccacgccggcctcgtttcttggcggaaaataaagaatatcgtcaacgtcgtaaattacgagctgatccttgggctgaataccattaccgggattgccggccggccttcttacgcttgcttttacgtatgtcataacttaatgatttataaggttataaaatggaagggataaagtaccccttccgattaatttagcctcttgccacttcgtagaatttaccgtcagcagctttcgccaatttgatgaacttgccttcggaaagcgttatagcttcggttaaaacaaagtttccaccgctggcaatggtagaagcattttcagaaccgtttccgtaaatcgtgtaaacgattccggcttctgcatcggtaaagttagtgattgccgttgcttttgtatttacaccggtaacgaatacttcaccgtcaagcaaggaaggtgtcgtttcatccggcgcaaactgcaacgcatcggaagaagcgttttcgcgaccaatctcgataaatttaccgtcggcacgtttcatcagtttgataacgtcccccttaccgggctgccaggcatcggaaataagttcaaaatttccgcttttctcgatcttaacacccttatccacgcttccgcatttcagggaaataaccgcacctaccggagcgtcttcaatatcggtaatcgtaaattcggccgtattggctacggtaacaatggatgtatgaagtttggccgacgggttcttgtccttgtcagcatccacgaagtaagacgccgggcggtcatactcattacagaagatcatctggcgcgtatagtccatatcttctttcttggtgtacttgaatcccacggcaatagcccagatactttcacgccagttactccagactttcaggctccagtcttcctgctccaggttgaaagccgtcatttcacccggcttatcctcgtaggttttaatgttaccttcaaacgtccagaagatacggtggtggttgtcagcattgggaaccggaataatcttcaccgccggatattccttcacatacatgatgttagccttgtaatcctggttctgcccgtaatgcaattcattgtatttatgatacaatacaataaagtgcgaaggcatataaagtgccaggttaccgctgtcacgaagaaccgccgggatcatggaagtacccttgtacactttttcaccgatgtttgcttcggtaatttcccccaattcgaacggcttgatctggtaaacgagttttccgttattgatatcggtatgtccgttcactttcttgttcaggaactcatacagtccgtcagctgcagcaagtgctttgccgggttcgttcagattcgggtccttacggattccgttaatacggcgttgttcacgctcgttatgcaactttttggcggtttcggccaggatatactcgataaaagaccacttgatagggtttgaaccttccttgttcaaagtgccgatccaagttttctccagggcctttaaatttttgaaacggtgtgcaaacatcacgttgaacatgcgcagggtttcatcgtcgaactcgtaggaacctttagtcaccttatcgaagtcggattcctcattaccggcctgtgaaaactcacccagccagatattaaccagcgtagccaaatcctgataaccggattcaagcgggaaaatactttcaatggaaggaagttccattaaaaacgactgcaaacgctgctgccagggaatacggtaaaaggccccgaggtcctccttcaaacggctgtagtcaatggaacttgctttcggaagagcgatcatttcaaaaccggcagcctccattaacgcagctttagcgcgaaggttatacgggcggtcctccagtgagaacatttcaccctgcaagccccccagctgcttttcgtcctggagattgaatttccctttaccgtccgcctgggcgttgtgttgtttccctttgcccggatcatcttccgcagcggccgaaagttgagcgataataccggaaagctttgttatttcggcatccttcttggcaattaacgcggtgttgttccggttctcgtcacgctgttgcgtctgcaaggcttcaagctgttcctgcgcttgtgtcagacgtgccgcagtgtcacccaacaaaccacgaaggaaagcggtagttttaggttcctcggtttcctctccctggttcccgtcttcggattcgtcctggaaatcgttttcgagggacgctttaaagtccgtgaggaatttttcggtaaaaccgtaatttttcagttttgccacttcctcgaccgtgatagagtttttgtcctctaccttgctccattccgacagacccagcagggccagaatgtgagcggaaaagctcttaaatttcatatatacaaaattttgaagttaatactatatgttatacatctcatttacttttctgacggtggcctgtgccagtacccactttacagcgtcttccagcgtgccgaactggtctatataaccgtttgccacggctacgtcgccggtgaatatctgtccccggaaaaggggaagttccggatcgtaggcaatacccagattccgactgatcgcatcacagaaaatacggtgcatgactgccagacgttgttttataggctcttcgttgttctctttttcaatcgcgcgggtttcatagtttttcagatcggcactatccggatagatttcccggtaatcaatgccctgtttcctaaaatattccttaaaagattggtaagtaagcatgatcccgacggaaccgacttcacacataggggaagcgataaaggttctaccggcggcggttcccagccagaaatgggcactccccatggtaccggccacataggtagctataggcttggaagattcggcaatcattttagccgccaggtccacatgtgcgaccataccgcccggcccattgatccagagtaccgcaccgcaaatcttaggattatcgaaaacatcccggagctgcttttccaggcggtaagtctcccaggaatacaaggtgccttccaggataatgacggccacactgtcagccggcaatgtctcatcgtccagttcccaccggttggcaaggtaaggcgtagtagcgtaggcggttattttattattgtcgagccgtttttcgatcgcatccaggttgccggctgcaacacacggcacaagtaaggaaagcaaccggtaataatcattatcagcgattgcccaaggtgctgtaaaaatctcctgtattttgtccacgttctcttttttacggcaaagaaaacgcctatataataggtagagaaggactgaaaggaacctacaggaacgcatcaacgcccggacccgtaccggacagggtgcagttatacaggcccccgccgatctcaaaagaaaaggtaagcgggtaatcgggagaaccggaaacacgggtgttacccgtttcgtcagtatagagggcgacaaagggcgtcgctttcaggttttccaggtaaagcgtcttattttgcgacacgtcggcaagcttgaaggtatgttttttagtatagacgtcttcatttttgctgtcacccggttttaaggttcccggtacgatcataagaatatcaggttttccgatagagcggataacgactttcgagagcacgacgccaaaatggataatgttgtaaacgggaaccagttgcaggctatgggcggcggatattaactttcttgacataattacagatataaagcattgataatcaaacattcagcatttttcggacgtttttcagccaaaaaccggacaaaaaaggacaaacagatacagttggtaggtaaaaaataacttgcttttttacactttttttcggttatacgcccttttcttcttacgcctgaaactgtcccgccaccgctggtagtttttcagcagcccgtcttcctgaatggaagagatatcatactttttcaggaaggtaaaaacggtttccttaaactcgattccgtgcaggtgcttgttttcgtccatgagttcgtgcagctcggcccacatcagggcacgcagacgcttttcaagaatggcggtaccgcgtacggaaatgtaattgaactgttccggagacttgccgccggcaaaattggcctcccggcggtcaggcagcataaactccaggttgccgcggtcagccggacaatttaccggccgtttctccatgagatcgtaaacggtcacatagatatcggacgaggaaggaaaacggacggtaccgaccgtttcgtcgtaatatttgccccggatatactcggccaggtaggattcgatctgtattcgggtggtaatcatagcaataacattcctttttaaaggcaaagatattcctttatcggctgttggtctgccatttacgggaaaatgtaggctttcagtcgtcattttgataaatatactccgggagaataattataatatgccttttccagccgccacacacccgacattttctctgccaggctgtgctaatataattcggtactaaatttttgtaatttcgtaaccgggcaaccgacaaaggtaaaatcctgtatcttagcaacttagtaacgttactaatttccgttacaaaaaaatggccggaaaacagtttgtaaccgggcttaccggtagaagataaaaaggccggtgttacaaaccggaaaaattcgtaaccgttttgtaactgcaacttcgtaacctttatttcctatttatttatttgattttcagacttttttctttcaagcaaacaaaggttacaaggttactaaaattttgtatgaaatagaggtggggtatggggagggaagccgggcgggacgcatttgtttccatacgaaaagagggaccgacacattcgtatctggtccctcttttcgtattttataccggctccgatccgtcttatacgcgatgtttgcacctgcttaaaatccatttctttacgtccgggggtatatagcggtgcacgacggccgtatagtcctcgttaaattcatactccaggtagttgtcgccttccaggataaaaacacaggccgttttgatgatccattcgagctgctcgcccgaatagcgttccagtgccaggacggtaccgggtttcatacgctccagatagcggtagacctgttcggcgaatttccggaacctctcgccgctgttccagagcgcggtaaactcggacatgctgtttaatttcaaatgcgcgttattcattcatccggtcgttcatcaggtacaaacatgagtgtcggatcggccggttccgttccaccaccggcagccgtttccgccgtgccgcatgaacgcagatagatcatgtcggcggccttgccgtcgttatccttacgtacaatacgcccctgggagttgcaaaggtccttcgggttgagctcgtcaatgtaagggcaaagggccacaaagcctttgagggcctttgtaaaacgctgcatcgtgattttattcacaccggaaaaacttttgtaatcagcaaaagccttttcacggacgataaagctgtccaggtgctcgctgtccggagagaaataagagttcgcccagtcctcaaagttattgcccatatcggccttgtatttacgcctgataatgttttccatgggcggaagcaattttatagattcctcgcaaagggaaaggtaaaaacggcagcactgcaagaagaaatttatatcggcgttccactcgttctcgctgtaagtcttggaaaacaaatccttaccgaaatcgtcccggatagaacgcgtttcccggtagtcgttatcttccgtacgctggtggtagtagtcggagaataccaggtacagcaaacgggcttccgtagacggatcaaaatcaataggaacgtaattagttgtaaatcccagcttggccgattcctcgaaaggtatagtaaacgactggttgttcttcgggttcacggtcatatctgatgtgatgatatcgtaaaacaggcccgtattaagataccggtcgcaatcatccaccaggataaagtcggtatgctggtttacctggtcgaacacatgcgggttatccattaacttgggattacggccggaaagcttgacggtcttcataaagtaggaaagggccttgaacatgaacgatttgcccgaacgtccgttacattcaccgtcttcaccgatcttgttatccatggcctgtggtgcccaggcacgcgaaggggatttataacggtgcaacatatagccgatagtaaagatcttgttgataaggttccttttctgttcggccacttcttccgccgtgaggccttccccctcgatatcgaatttatgtttttcccggtaggattccgcttcccccacgctcttgtcgtcgaaattatattccagttccttacgccagtaaacgcggctcgaattgattacatagccgaaaaagttagacgggacggcattgatccggatatcaaaaacatcgttcccctctatgtcttttttacgggaaatggtaaacatgtcttccataagacgaactttgtgtttcagtacgttttcttcccaaacgtagtgggacaatgtgctgccgttggccggatgttcctttataccggtaccgcttacctccatgctgcaaccgggaaagaagaacatctgcgtattatgggtataattggtaaagtccagttctatttcctgcaaattgtccagggccgtatctgacagtttggggctgttcagaataaggtttcttatatcgcgggataaaaaactatcctgggcccaaccgcggataaacttccggatatcctttgcctttatcagttttacaatattgccggtaatacggatgtatttcgttgaactggaattttcatcatgaagcgaatagaaaccgttaagacgtaaaaagtagtgaaggcagtccgcgtctatattgtgatcccattgccgggatttctcgttaaacttggaataccagaatttggcgggcatggcaagcgtcataaggttacggaaatcctcgttcttgcttcgtaattccataaagtcccggaagtccttacggggtttgccccgctgatcccggtaagtggtaagccaggccggtagccagatcgtgtggatatcgataaaacgtagtgcaagttccgtaccctttaccctgcccgtcgtgtcgatatcgggtatgttatacaggacttcaacgtatttcatgatctccttgtagtcctgttcggaaagtttatatgtttccgaattaaaccagattggggaaaagcccagcgatttaacgcacagggcgtcgcgctctccggaacatataaacgcctcctgcagcttctgttccttataaggcttttccgcattggccggattctttttaaaggcggcttcttccctggaattaaactcccagtataaggctttcagttcggaaagaccgtttatatagtccttcggcttgacaccttccggggtgtaggaaaaacgccactgcttgtccggattcagaggctcgtatattttatagaacttcacttcgggcgtgtcgccttcggccggttttaccagacattcgcgcataaagatagggtatgtcgcagtcgcgtatttataggttacctcgcgattttttacataccctatatatttggccgaataccagtgcagagcctcggcgttctcctgggtgacacgggggccgagtatgcgtaactgatccggggtgagatgatcggcaagctcgaaaattttagtaccgtctttctgatcctgggaggccggaaccttacggatatccggcttgtttacgttacggttgagttcatcggttacgttgtacatggatgcaagtttaaggatcgcctcgttaaaccggaggccttcctcatacatgcagatatcgacagggctttgagccgttccggtatcaccgaaatccgttaccttataaacctgctgggaaccttcctttccgaatagcttgatacaggccgacgcgtcgtcttctgacggccggcgtttgaaatggcggttggttccgacacaatcccgggcttgcggataataatgtagaataatatccagcccgttgttggttactttgtagatgtcttctgcctttatcatcgttataaagttacatagttacttatttttcgttgttttcctcctgctttgttttcaagtctccccaaggttgatacaggaaaacgaataataacagccaaagaaaagcggttttacccgtataataaatgacaaaggcaatcagtcccataaaggcaaccacgataatagcgtgggcgatgtattttaaatttttatctttcattgttcaaacatgttatactgaattgaaaaaccgaatttgcttaatctcctttcctggagaagggaacgtttgtcatgtgaaggcataatgaccaccaggttctttgtatcgaactggtaacctttcttccgcatctgataacgtaggtttcttaggcgtctgtcttctttcatggcatttcgttaagatcgtcttagtttatagaaggcatggcacactatcacaaaggatagcgtttaaatcctcctgtatggtttcctgttgcttcttgttcaggtgtaccaggaaataaccttttccgtcggaaagattctttatttccgccagattatacttccggtccattgcatccacgaatgcaggggattccatggggcggaagctactgaatattttataggttccactactgccttctattcgtaacgtggttaattcatcgggggtggtaattgttgatttcattgctgtattatttttagaaaagtccacataaagtgtaaaaaactgatttatatttatcgctctttcttcttttgtattagaaagatacacccttttatttttcttatccatttttatttaatctcttgcatcagccatttttcggcctttagccgttgccgaatagatattcggtttatcacctttgaaacatttagtctttatccattcatatctttcagcttcccggagataaaataatattccgtattcagatgtatttttcaaccaatctaatttcttgatttgctcaaatgtcataggaccgccatatacaagcgatgatgttaacatctgaactctttctttcaatgaatattcactcatatttaatttgttttactctaattgattcttacatacttgccacttatgttacaagttttttagtatctctgcgttttcttctccaaaagcgatcaaaacagcaccacaaccaggcgaatccccccgtattccgtccggcctgaaaaaacgaatccttccgcgtagaaatttaattgccgttgccttctcaaatataatatcctggaacatcttactatcacagcggttgaacaacagcgcaatgccattgccgtgttgtgccagtttacgaacaaattgttcaataagcggacgggaataaggtggatttaaccagacacgacctacccaatctttagttaatccgtcatggtttttgttgtacatggtttctgccgtttgccaaagcggtttaaccggagcacatggatctaaatcaaactttcctaatgcgtctataatttctttgggtgtataccactcatcagtggtattagccgatttttcaaaggttgtattcatatctatcatgttatgaggggttatacaattcatatccattatcccaaagactatcactgcgaaaattgaagaaatcttccaaagagatacgtacaccatcttctaaaagaagaaatccgttttcaatagtcatccattcgtcagaggaaaagaaacggtgcgtaaccttcttaccctctttcattgcttgtatagcttcttctttgctcattatcttttcttgatttgaattatttttcaccacttatttttaattttaccaattcaccaataggataggtcgtatgtttcggtctgtttattttcactttatgagaagaaagaaacaacggaacaggttctattcgatagaaagtgtagtaagcttctttaggagctgttttttcatattcctttaaatattcttctgctttatttctcgtatcaaatgcggcaaggatagaaaaccaaacgccgtcttcttcgtatattccggattcccttttagttactatgtaaattttgctcattgttgtttatagctgtgccggaggatagcatcgaactaccaataacacccgctttcgcccttcggggttatctccacactccggcggttattatatggagcggcaaaagccgccccggttatttattcacttttcttttccggaagaaaaacaaagtctgcccaaatatcaaggaattgtcgaccgcaatatgctgccagttccgacgttttgaaggcaagccgaacgccgatggacgcaaccgtgctcgatgaatcgtaactcgcgaacgcacacgaaacaccgcccaacgcgttcgcgttgtagtacgaccgatacaccacacgagacttttcttcctcgtccaacttattgtattcttcccctgtataaagaataaaccaaggataataacggcattcatcctctgtaaatcgaggttcccagccttcatttaaagctttgacaatgatacggagtttcagaaaagccaaaacgtcaggttcaagaccgagggatattttatctcggttccatgcttctgcatcgatgccaatttcatggcaggcgtcctcaaacgtcttaatacgttttcttacgtctttttctggttcatcaataagggttaagattccatttctccagacagctgttttaccttccggaatttcgatttctaatttctttgatttcattcttcttttatttattggttttcactatggaagatttttacgcctgttacttcctcgatcttatcctttgcaagttcgggaatacgacaacgactacctcgccaattacgaaaggtatgtaatggcactttacatgcttctgccaatttaagggacatttcagaagattcttttaccggcaaattcaaaaggtacattcttagtttctcgccgtcatcattcctttttaatttttttttcgtcatacctttgtgataaatatactcattattgttaactttacatagcaaaggtataattatttttaccacaggtgaataaaattcacgttaataaaagttataacaaaggtgtaatatggctaattttttgttaataagagagttatgtgaattaaagaaaatcactatacgagaacttgcttcacgtataggaaaagaagatagtagcatacaggctattgttagaaatggatcaacgaacacaaaaaccattgaggcaatagcaaaggttttagaggttcctgtaggtgtattctttgatgatattcccataactggaataaaatcaaatgaacttgataaagatgcaaaaatagctgatttagaaaggataattgaggagaaggaacgtctaatacaagtcttattaagtaagaaataacctgtaatagataagaaatgtaggcatattgtaggccatacgtttatacaaacaattaataatcaggcgattaaagaacgttacttgaatcacaacgaaaaaccgcaaatagctaataaaaagcttttgcggttttcttgttttagaattagaaaatgtccgcataggttgtaatgggaaacaaattggagtatttggtttacattgcaggcaagatttatttgcgatacctggagaaaaaattatcaatccaacggactagatatactataataactccggctatgaccatactgataatacgtaccaacataatttatagaattaaagatttgtttttatagaataataatgtgcaaagataattgattggtggagaaacaaaaactctggaaaggatataaagataggagttaacgcatattttcacggatataatcctctattgtaaaatcactcttatatctagatatttccggattcttctctacagtcgtaatgcaacgtttttctttaccaagtaccaaccggtttaggaagctcaggatgtcacgacgattatccttcataggagaataggatagggaatgtcctataccttccgctatatagaaatagtatgctgtctctttttctttcagttgcatacagataaagtttgagccccatagccccatttcctcttctattactgccttagtaaaaggaaccgtgctgtcggcatcaccatagaacaacataagaggacaaggggacattatccattttggaataccattggcacagattgctccagaaaaggaaatgacccctgcataattgaaattggcaggtaatctgtccgcaaaggccgtttgattgcaaatctcatactctgcttgaagggcagttatcgcacctgcacttgaaccgcaagctataatttgtgcaggatttatttgccattctacactatgctcaattatatgatttgtagcatcaccaaaatcttctacagcacaagtgattgcttgttgcagggcagaagagaatccttgcaagtccgaatactccgatttatctatatcctttaattgggtgcggtaatctgttgatactaccacataaccggctcgtgcaaaaaaatgaacccaattatatactttaatgtactaattttaattctatctatttatatcttatttcaataagggaaatcttttgggtttccctattttttatgcccattttcaagtgaatcaaagaattttgttaaagaatcctaagtagataacacttgagattggatttgggtataattcgccaaagtagttttcatggtagtaaaaaccaagtgttccaagtatcgtactggaagcacttggttaatgtttaaatgagcaatattaatttgtcttaaataaaggtcaaatgcccaagttgaattgaggtatttgaccataaagataaatgtttcataataattgttatatcaaccttgatttgtaagggcactctgatatataattttgatagttcataaaaggactatcaaaaagtatatgagaaataaaactatactaattattaaactattagagatagtcctaatagttttaggaatgttccatgaaatacttgaaatattggaacatcttaatgccctgtaatatacaggagatatgtaacaagaacccgactctgcaaaatcgggtttattttttatgtaacattttatctttaaatatgtatatgataattatactcaattgttttatttaagtgcctaatttttagatacttatttttatatgttatgattttttattatatttatataataaaaataacatgtcaattggaaacagaaataatcaatattgtagaaataataaagaagaataaacaaatgcgagaagtaaagtcatttattgatttgatgaaatccttttatggtgaaaaatcatgtagagaatttcttgaagatattaaatggcatggagaaccgatttgcccacactgtaattgtcaaacgaaagagcattataagttaaagtctaatggagaatttaaaggactatataaatgtaaacgatgtaagaaaagatttacggttactattggtactatgtttgaaggtagtcatgtatcattaaagaaatggttctatgcattgtatatattcttagtccataagaaaggaataagtagcatacaattatctaaagatatagatgtaacacagaaaacagcttggtttatgttggaacggataagacattatttgaaagacaagcttgtagttcaatttaatgatatgacacaagttgattaaacctatgtaggtggtaagaataaaggtagagtaaagaatgcacaaggaagaagccttaaagttaagactcccgtagtaggtctattatctaatggaatggcatatacagccgttgttccaaatactggtggaaaggttttgaaaacgataatcaatactttagtcaaggaaggttctaccgttataacagatggatggaaaggttatactggaatatcgaaaaattatattcataaagtagttgaacatagtactggcgaatatgtaaaagacggattccataccaatagtattgagggattttggtcacacttgaaacgtggaatattaggaatatatcataaggtaagtccaaagcatttggataaatactgtgatgaatttgcatttagatataatacgagaggactaacagatgttcaaagatttatttattttacgatgtcagcctataaaagattaaagtatcaaagtttgatttacccataagaatgggtaaatttgaattgaaaatagaaaaagagcagttcacgaagtagcatttttgctaaatagttcctatatttgcattgtcccaagtggacagacatagtttaggaagcgtttagcttattccttgttaatgaatctggacaattcacctgcactgaggaatatgaaagaatgctccctttggtttgcatatatagcactgatgtgttgatatacagccaaaggcgtgagctgttttcatttttcggtgcagaggtagtccagaacccattgacggaatttgataacagtcttgcgccttccctattttagaaaatgctttctttgagactgggggagcgcaaagtgattgtgtatgagaacagtcttctgcaatgattgtcatttgtcggatgatattccaaaattagttgctgatgaattgttgggtattcagcaattagatatgttaaaggctcgttataagcaaatgagaaagtgctatgacttctcgtatgcagaatggcaaaaagagttttccgatgatttgaagccttttaatggatatacagatactacctctgtttgtattcccattttgaatccattgtttagaaaagattttgcggataaaggtgcaataggtttggatttgccgacttggtttaatgttcaagtcgataatgtccgaattatgcttattgcgcaagacccgttacgtgatgcaaaatggtatgaagaatgccatgatgcaatagtgtcaagtccatttgggttacatgatgcaacccataggaaaagtggaagtggaggtaaaatggccgacttgttgattaatggtctgattaagaaaaggtttgcaatatacttgactgatgcgaataagtattttgtacatgatagagaaatgtctaagacttttgctgaaaatagattaaagacatatactgatatattgcaaaaagaattagacttagtgagaccaaatctttgtgtttgtttaggtaagaaagcgaaagaagttttggataaatgtatggtaaatgtcaaatcaataatgttgccgcatttgtcgggaactgcacgaggtgcaatagtcaaaaggtttccaatattagaagacattaaagcaacagccgaaaatgttgcaaatgtatatgtagatgaaattgttgaatcattaaaatagtagaattatgggttgtataacattcgtattgttagtattgaatatcattgcattagttgcaatagatattatgttttgggctgaaagtgcagcttcgggacttgctggagtatttggtattatagcattctttataggatatgctttgagtgtggaagtaacgattgctccaagagatttttgggtaaattctgcatttggcatctttataaagaaacttggtgtagccaatatgacagcttttgcagtgtggtttatcggaaatttgataattgggtagaaacattaaaatgagaagatatgaacaataatgaaaattcagttttagagtatttgaaagcaaacaatgaagtactgtttgataaaatcgtgaatgctttgcgtaaaggaaagcaagttaattttacggatattaatcaaagtgatattatcattttgagtccgcagaaagcatttgaatatgcgggagaagaaggcgataagtattttaaagtttggatggtagggagtactattgcttggtgtacttgggctaattcaatggttgatagcgatttccgttggaatgctaaggcgagaaatgaaaacaaaagagataataaggacattttgggtaatgagccttatatttctgcctatttgaagtctaattctgccattgaacaatgttcagtagtttatatgttcccgtttgaagccttttccaaaaagaaagtagaagttgtgaagaaggtggaagaaaaagaaagtaaaacagaaaagtctgtaaaaaagacgacaagtgaaccaaatagtaaaaaggttgaagatattattgatagcctttcatggctaactgaatgtatttctaagaaatttgcaccaagtcccacaatgcccggatttggtatgattacaagagcttgggataagcagcaacttattggggaacgtgctgaatttgatactaaattgatgaggttgaaatgtttggatgagcataataagatgataccgtattttgagaagaaagcacaagagtgggatgagaaaaaagctggagtgtttgaaaagatagcgaaagtgttaaaaaaataataagtagtataacagtaaaagccaaccgacttataattaagtggttggcttttgattttagaaaacatccataaagatggattgttttctggtggtcttttattgcgatttttggtcgtttaatttagtttctctatatttgtattgaaaattaatgctttagattttttagacgaatgatagagcattaagagtattaacaaatctaaaagaataccattatggacgatttaaatcgtttaaagaccttattggaaaaagtatttagtaagtgtttaaagcaggtgtattattacatttatatgcctgattttagaggagacatgcaagtcttgatgaaagaaagaccatgtacttctaatatgatacgtaattctttaaaggaaatggatatacctgttaaagaattaggtaataatggaatatgtatttttatagcttaattgaaaatttgcaattaagaatagccgcacctaagtttgaatttgggtgcggcttttatttttgtgtgattggtgcattaaagtatataattgggaaaatgaaaataagaaatgtaatcgggattatctcttctcccgcctttgaaacctcccccaaatgcaaaaagaatgacgggctttgattgtgtcccttgtatttgatcaatcattacatacttgtccagtttcagagtatcagcctttttgatggcaaaagtataggtttgcttgtcaatatgttgtgcatgcacaacagtagctatactcaataatgagcatgccatcaagataaaaataaagcgttttcccatattcagtttattctattaatgttgcgtggattatctgacctacaaagatagaataaaactataactaaaaaggggaaagatgacatttagacataaaaaaaggctatctatcccagacagccaatcttttttattaaccttaaatctaatactatgaaaaacacagtacaaagatacgtacttgcaggagatatccaaattttagtgggtaatcagtggatattataacatggtttagtagaatattatttctgttaaccattaacataaataatgttcgatttaacaaaagcaagaattaatattcctcaccaatgattgcaaactttaatcatatcgacggtaaatccaccattggcggatataaattttccttttcttttaagaaattctataagggtatctacatccatattgtcggcagagcaagtgaagaaacgctgccgctctccgaatttttggataatggcttctctcaatgataactcagtataactattaccttccatcatgtggaagatttcatgtgcatgtaattgttccataatcttttttgttgcaaagataatatgatattcaaagtataagtgtaacatatgtgacaaagccccaaaaacacatccagatatttgcttttacgtaaaataacacttgttacgactatactaaaaacctcaaaaaaagtaaaaaggttttgcttctataccattgtaaactaactttgggaatcaacttttaaatgaattaaagcatatgaaaaaattaatcttatctattgcactatgttgtgcagctacgaatttctttgcgcagaatgctgaccctgcccagttggtcaacgatggtaaggctgctcttgaagctaagaattaccaggaagcttacacaaaatttagtacttatctaacacaaacaaacaaccaagactccgtaattgcatataactgtggcgtttgtgccgataagataaagaaacctgccgaagctttgaagtattttgatattgctgtacagaaaaagtacaacttggcaaatgcttatataggtaaagccggtgctttgaaagatttgaagaaaaatgatgagtatgttgccactttaaaggaagggctggaagcaaatcccggtaacaaaacattgactaaattgtatgctacttattacgtaaatcaaggtatcatggcgcagaaagccaaaaagatggatgcagccgaagaagcttttaaacaagccatagctatccaagcagataatgtaaatgcacttaacagtctgggttctttgtattatagtaagggtgccaataccatgaaaacagatgtagaaaaagcaaaagttgaattcaaggaagccaaagaatatttggataaacttattccattgctctctgcaaacaaaccagctcaaaagaagatgatggataatgcaaaaacgatgttgaacttcatcgacagtcaattgaaataaaagactctcctatataaaaaagaggcagatatcaattcagatatctgcctcttttttaatgttataaaatgattatttagttcttctcagtacaacagctgtacgtgccggtatgtaaagcttcagccactccttcttgtcttttttataaagcggatcgtggatggtaaaatgtttgatggtatcatccgttaaaccattaccgccataatctggattatcagtattcaaaataacttcataagttccggcaggaaccaagaaaccataatcagtaaaagactgcttggggttgaagttgaatacaaaaatcaagtccttgcgcatataggccaatacctggtcaccgtcattatgccatatttcttggaccggagtagcttggaagttctttatgctttttacaactcccaacatggcagcatcaaagtcacccatataatgatatgccagattcttgttgtccaccaaatcccattgacggcgggcatatttacatgaccaaccgttaccttcacgggggaagtcaatccattccggatgtccgaattcattgcccataaagttaagataaccgccgttgatagtagtcgcagtcagtaaacgtatcattttatggagagaaatgccgcgatttacggtatagttttcgtctcctttctgcatgtgccagtacatatccgcatcaatcaagcggaaaatgatggttttgtcacccaccaaagcttggtcatggctttccgcataggagatggtcttttcatctttgcggcggttggtcacttcccagaacatgctggatggcttccagtcctcatctattttctccttgattgtcttaatccaataatcgggaatattcatggccatacggtaatcaaatccgtagccgccatcttcatattttgccgccagtccgggcattcccgatacttcttcggcaatagtaatggctttggcattgacttgatggataagcctgttggcaagtgtcagataacaaatggcattgtcgtcttgatgtccgttgaagtaatctccgtaattacagaatgcttctcccaaaccatggctataatatagcatggaagtcactccgtcaaagcggaagccgtcgaaatgatattcttccaaccaaaatttacagttagaaagcaggaaatgaataacttcgttcttgccgtaatcaaagcaaagtgaatcccaagccgggtgttcccgacgtccaccgggatagaaatattgattaggatcaccggcaaagttacccaagccttccacttcatttttcacagcgtgtgaatggacaatatccatgataaccgcaatccccatgctatgggctgtatcaatcagttctttcagttcttccggagtaccaaagcgggaagaagcggcaaagaaactggaaacatggtatccgaagctaccataatagggatgttcctggatagccataatctgtatgcagttgtagccttcttgggcgatacgtggaagaatcttttcttgaaattccttatagctaccgaccttttcctcctgctgagacataccgatatggcattcatatatcaacaaaggatctgtagacggcttgaaaacccgcttcttcattttatagggtttctccggaacccaaacttgggcactgaatattttagtctgttcgtcttgtacgacacgtgtagcccatgcaggaatgcgctcaccgcaaccgccgtcccaatgtaccatcagcttgtacaagtcaccgtgtttcacagcatcagcaggaagcttgatttcccaattgccgtttgccttgcgtttcaggctgtatttcttttcttccttccaaccgttaaaagttccgactataaagatttgggttgcgttaggcgcccattcgcggaaaacccagccgtcgtcagtacgatgcagaccgaaatagaggtatccggatgcgaaatcagataaggttaactttcctttattggtcagttctagttctttgtctatggcatgttgatgacgtccgttgatggcatcggcaaaaggttccagccatgggtcattcttgattaaattcaatgtttccatatagaggatgagttttggatatttgataaatttacgctttaactttcacaattactttttttacaccgtcaggagtaatacccggagcatgcccgtcccgagggaaaaagatagcaaacattccgggcttcactgcaatatagctctctgccagtccttcaaaaaaagtgatgtctttttccgcattgtaaggagcatcaaccggaaggcagtcttgggcggcggtataacctattatctccgtaccggacaaaggtatttgaatgtcaatatagtctttatgagtttccagtttggcattctctttttcttttggatttgtctgagccacattgaccaacaagtcctttcctttcagttcggtcttgccgatttccaaagagtgcaaatcatgtgattttaaaaaatcaatggcctgctcaaacagaggatgcagcaaagtatatttttctatgttttcaagtctgtctacaaccataattcaaatgttttaagttagttatataggtaaattattcaaagtcgtctatggtgtaattcacaaaatcagaaaaacgcttcatctgcttgaagatgtcgtctgtacgatccaaaaagtctggagcaagaaagaagctgtccggctggcagcaggcaaccgtatactctttacactgaaggtatttcagatagggatagtcctttggaaatccttttggagctgtttttagaaaattctctccgatgatggggaagtattgcttgaaagcgggatcttccactatgctacgaaattcatccatattatcgtatactgcttgtcgcagagctcttaacaagggcgagggaggacaataacttccaccggccaacaggcagtttcccggttccagatgcacgtaatagccacaatggtcggatttctttcctttcgcattgatatatcctcccagatgtgtcttgtagggagttttatcttcggaaaagcgtgtatcacgataaatacggtatgtacagtcctttgcttctatgccacggatgctttcatcaaacaaagagatacgggagataattactgtaagcaagttttcaaactcgctgcgggctacttcatactgttcccggtgagaattgaaccattcacgattgttgtttgcagacagttctttcaaaaattgaaatataacagggatattcatatcatattctttccttattatctgccaaatttacggataatatttctaacatgctacaaagaagggtaaaaaaagcatcggctctggtaaaccgatgctccttacacatttatcaatcaaacagacgcttctgtttttgatgtacttacttatcacaagcgggtacgtctcttttaattaatcttatatctaatactatgaaaaacacatttatataacacaacaaatcgagattttgttcatgcagatgaggataactttagcataaaaaatgggtgggtcattttattctgcatccagtttgcactatctttgcaagaaaaaatgtagaatatggccgaatataaatttgatgaagatagcgttaaagcgctgatagattgggcaaagagcacatctttccctcaaagtgtaacattgtctgatgctgagaacatagtggatgtgaaacgttttgtgcaagctaacctcagtgatatagatgcacattatcctgatgatttttataatcctgccatcacgcggctatatcgactgaaggaatatatggaagagaaccaataaagacttggcactgattatgcggaaagccgcgaagcgattaagaaatccgtgttgttctgcataattagtgccaaacctaataaatcacctgagttgtgcccccattatagctttatcttaagtatctttcctccatatccttcgacggccacattagtagccttatagggaagcagacttatgttttcttcttttccgctgagcagctccgtagctttgtactgatccatctgcggtatttgcaggaagtcaaaagcatgagaaggaatatttatggcaaggtctgccgagatatggtcgaagttcacgacaaacagcagcaggtccctctcaaatttgcgcaggaatgtatattgcttatgttcattaaagcgccatccgttgacattggcatacatcaaatcgaagaaagctccttgagagatggccttttcttcattgcaaagagtcagcaaccgtttataaatgctgtataggtgtttctggtcctccgtcagcatcttgccgtcgaacttgccgtcattgcgccaacggcggatggtatctacactccaatagtcaaagatggttgtacgtccgtcccggccgctgaaaccttcgctatccatgcccagctcaccaaactcctgaccgaaataaatcatcatcggattggtgttcatgcaggctgacacaatgagtgccggaatcgccttgcgcgggttactggcaaaaaagtcggaagcgatacgttgctcgtcatggttttccagaaagttcaacatgcgtttttctatgcctcccagactttgccaagagcgggtgatggcagttgccgattcatacccgcaagtaacagctcgcaaggtatcataaagtcctactttgtcgtataaataatcaaacttgccacggaacaagtaattcttgtattctcccgggttgtagacttcggctataaacagcagggagggatattgctccttgacctgcggaattgcccattcccagaactctacgggaaccatctcggccatatcgcaacggaaaccgtctatgttctttcccgcccagaacagcatgatatccagcatcttggtccatgtatcgggaatggggtcgaaatggcaagtcccgccgttctgataatccactccataattcaactttatagtttcgtaccaatcggtaatgtttggatatgcgtcaaaacggttgtttccggtagcttttgccggaaattccctataaggttcggtggctgcacctttcatgtcaaattggccatgcagttccgatttcgggatataatagaagttattatatgggctgaacgcatagttggtatcatcgtttgaacccagttgtgaagtgccatccggctgggcatccgagtgatattgacgagctacgtggttgggaacaaaatctatgatgaccttcagaccgctacggtgagtgcgctgcaccagattctcaaactctttcatacgctccggtacgtccttggcgagatccgggtcgacatcatagtagtccttgatggcatagggagatccggctttacctttcacaatggccggatggtcgggttggatattgtgacggcggtagtcagtttgcgtagcatgctcaatgatgcccgtgtaccatatatgtgtagcgccaagcttcttgatttctcccaacgccttggctgtaaagtcagccatcttgccgcatccattttcggtgatgctgccattattgatgcagtggttattgttgtttccgaatagtcgggtgaacacttgataaataatcaatttgttttcgtcgttcatttctttgttttctatgttatagaatggttattttattctttccaaatgctgcctttgtctatgaacaggcgttccaatatatcattggtcgtattatatccctgcatgaatatctcctccgccttttccagctctgtattgctgtatccctccaagttataaggttctatcagtaaatcagccttctcgcgttcaggaaaagagttggagcgaaacataaagttataggaacgtaaggcaatactcacaatgttcattttatacttggttgccatcaaagggctgacattcacggcaatcactttttcgcatatacggcggagggtagagacaggcaggttcatcagcaggcctccgtccacgtaatgggtgccgtctatattgaccggggcaaacaataccggcatgcaacacgaagctgctacgcgttcggcgatgtcccctttatggaaatgtaccagacgtccgtggtccaggtcagtagctgtaataatcagagggatttgcagttcttccagtttcttggatttcagattgcttttcaggaaatcgatgaactctcccaattcaaataatccgactttgggaatcaccagtttggtcaggtcctgaaacttgtgcccggcaaagtagtcaagaactttatgcggttcattgccgtcggcgtagaataccccggccaaggctccggcactgactccggaaagtatattgggcttgatgtcatgttccaataaagattgcatggcacccaaatgggcaaagcctttgatgaaaccgccgctcaaggcaaaacctatcggatattttttagtgaaccagttgttcgttgctacctccatgttgaaaatataatatattgttcggcacgaaattaatgattttatcgtagggagaaaggaaaatagcggaaaaaagttcaaagtattaagagaaaagtcttctctattaaggagaaagtttttcttggttagggaaaaagtttttatcagttaagaaaaaacttagtttatggtttgcggatgtctatcccaagtcttgggatagacatccgcaaactggggatatgtatccgcagtttgcgaacaaagttttaggattaagggatactgtttgagaatatacgcttaattttttgcgattgctttcagcagtacatatcctccgaaccactgaatcagcatacccggaatgcccatacggaaatcttgcacagccagaaagaaattaccgcacagagcccattcaaaggccgtaccgataatttgataggagagaaccacgcccagcaatgccaataaagagatattcttggcatagcgtgcagcaagagcggcggctccggccagcagaccggactttataagtatagccggcaacacggctgctgcaggcatggcaaaaagcagatgattgatgaccggcgacaggatagccgtcagcagacctaccttgaaaccatatttataagcagctatcagtgtgaagaaatagatgggaagcaacgtcggaccgcctgctgggaccagatggcagagttgcggcaaggcgatgtttcctgccacgaacagcagggcgaatagataggtctttacgttgccgaaaggcagggaataaagttttgcagatgtttccatttgtataatattatgcattaattgataaatctatttttagtatgactgtttaaaacagaaaaggtttagtcaaatcttcaccaattcatatttcatggttcccaatccgattttctcggcatggcgcaacccggcaagccagtccgtgtcggggtgcatcaagtggaatttgtcgcacccgcacaagtcatcgtgctcgtgtgccgtggcgaggcaattgttgccgtgcagtatcggggcttggatgaccatatctgcacatgccttgtccagtgcaaccgggtctgccgaagccaggatgccgaggtcgggcacgatggcggcatcgttgtggttccagcagtcgcattcgggagatacgttcatgatgaagctgatgtggaaatggggcttgcccataacgacagccaaggcatattcggcaatcttgtagttcaggcgttcggaagtatcttcggctcccatcacggcaccgtcgtgctggcagagagctacgcactgtccgcaacctacgcatttggtgtagtctatttctgccttgcggcttgcattgaggtgcacggcgtcgtgtgcgcagtgtttcacgcagatgttgcagcctatgcagttttctacgtcaatcttgggttgcgaggcgcagtgcagttccagctttccgcctacgctggcacatcccatacccagattcttcaaggcgccgccgaaaccggcttgttcgtgtcccttgaagtggttcatactgattacaatatcggcgtcggctatcgctgtaccgattttgggtgccggacaatattccccgttcagagggatttcgcggtagtccgttcctttcagcccgtcgccgataatgacctggcactgggccgagatagggttaaagccattctccatcgcactttgcaagtggtctacggcattggcacgacgaccggaatacagcgtgttgcagtccgtcaagaaaggtttggctcccaggctgcggagcagggttgccattcgagctgcataattgggacgcaagtatgccaggtttccgggttcgccgaaatggattttaatggcagcaaagctatctttcaaaggaagttgctcgatgcctgccctttttcagcaagcgttccattttatccaaaagattggatgtaggggaggtacgcaaatcagagtagtatacttttgctttttccatgtgtttttacctatttatagtgatagtatctgcaaaaataacggattatttccatattaataggtatatggctaaaaaaagtagggaaatcccttttgacaaatagggggataataagaggtctatccatgtttctgcctacctttgtggcaactaaaaactcgataagatgaaaacaatcagactaattattgcgggactggtaatgacgatgggattcagcagttgttccagtttgttttatgatgctaaggtagatgtgttgaacagtatccagaaggggatgagcaggcaggaggtcaccaagatattgggaactccagagtatcgccgcttcaaccgggatatagaagaatgggaatattccagagtgctgtccggtaaaagtaatatcagccgaactcagattgtcgtgacttttgaaggtgggagagtcgttgcaatggactcattctccggagagccacgtacgttgccggttgttcccagtgaagtagtgatagattctccagctccggtttatgtcagggggatgcaccccgaagacttccggcatttttatgaaaaagtgaagtcccgccctttcaaggatgatcaaatcgaaatgatgagaactgttgcccgaaacaacagtctgaactgtgtgcaatgtgccagtttgatggcactatatacttttgatgacgacaagatgaaagtcctcaacatattcgctcccaatatcgtagatccggaaaactacgaagcgattttagacgtcattgattcactgttcaagaaagacgatgccaagaaaattctgggcatacgctattaagaagcaggcatgtcgaaacgcattgtccgttggtgccaaacacatgatgtatcggaggctgacagataatgcgtttaaggtaaacagataatgcgtttcgacgagctcttattccgataaaggaaagtgccataacggaccgttcccgtgccctatattcatgtctttcccccggtttatcgcagtaccgatatactctttagccttgcagaccgcttcatcgagtttgttgccaccggcaagaaatgtagctatggcagaggaaagggtacaccccgtgccgtgcaggttacggctctctattttgggattggaatagaggatgcatccggatggcaggacgtcagccccggcagaaggttgccgacaataaagcacgtcgcacatgtcattgccctccagatgtccgcctttgacgagaacagcggtattgtatctgcaggataattcctgtgccgcttgctgcatctccacagtgccggcaatggttcgcccccaaagcaggcttgcttcattcaggttgggagtaatgagggtgcatagcggaaacagttccgccttaatgacttgtatagtttcttcggtcatcagtcgccgtccactggtcgatatcatgacggggtcatagactatacactccagagtataagtctgaagacaatcgacaatggcggtcacaatactggcatcatgtaccatacctatcttgacggcatccggccttaaatcatccataacagaggtgatttgtgctttaaccatatccgcaggtatcggataaaccgattgtactcccagtgtgttttgtgcagtaacagccgtgatgacggaagcggcataacctcccaaagcggaaatggtctttatgtctgcttgtatgcctgcaccgcccgaacagtcggaaccggcaatggaaaggataatagggggaagcatgaaataattaaaaattaaaggggtgagaggaaagctgtttcaggtggaggaagtgggggatgaaagcttccttcgcttgctgccagacatctcccagcagtacggcacctccgaaacctaaaacggctatttccggaagatgtttcaagctgatgccacccaatgccatcacctttgagtcgataataccagcttgctgcgccttctgcaaggtatcgcaggagtaagcggaagagtagccttctttggatatactgtcataaatgggactgaggaacacatagttacaatctgatttatgtttcaacacttcttcaagagagtgacaagagcgactgacatgtcccttatatccggacggtatctgtggattgcgtccgttcagatgaattcctttcagaccgaaaacggatgccagctggaattgctcatgcgtgacaatgcgtggtatatattccatcggtagctgttgaagaaaattccccacctcctctgccgaagctcccggcttgcgcaggtggagtatttccaaaccgttttggaataaggaggtaactgccgctgcttctccttcaaagaattgcggcgtggtaatgactatcagcttcatatctttatggatgtttgtctataatgagaaaatatacgactgcatggtccttaaatcaatcgtccatagctttccaaccaagggttcaccgtagccgcaaatcagtttcaatacttcattggcttctacgctacccacaatggcaggggttacgccgataaccgatttgtccggagacggcatgagcagtgtcccttcttcatccggatagagctcacggtagtttttcgcaccttcaccgtagcagaagacggacacttggccttcaaagccttgaatggcaccataaacgtagggctttccccaagcgttgcatacgtcattcagcaagtagcgggtagcgaagttgtcgcacccgtctaccactatatcgtagttccttatcagttccccggcattcttcttgtccagacggaaggggtacgcttccacgtttacatcgctgttcaaaccctgcactctacgggcgccacatagaggtttaggctgcccaaggtcagcttcagcatacagaacctgacgttgaagattactgatgctgacctggtcatcgtccaccaatcccagcgttccgactcctgctcccgccagatagagggcaatgggagaacccaatcctcccacaccgactatcaacaccttggcattacgcagtttctcttgtccggcttcgcctatttcagggagggacgtttgtctggcatatcggttcatttgttcattattattaaggttctgtattcggccactcatctcttgaaagccttcaaatcaaaactcgcatcccaatctttccacaccggttcgcgccccaggcgtttcaacgctttgtccacttccacagccttgcgctcgtcgctgacatgaaactgttccagcgtttgcggatagctgtaatatcctcccggctcggtcttgctttcggcgctcatggttgtcacaccaagtgttgccatatggtcgcgtatatcggcaggctcgcgggtggagtaggagatgtccacatcatgatcaaagatacgcatggcaaaagtgacttgtgccagttcgcggtcgctcatgatgacattgggctggaagccgccattctccgaaggacgcatacgggggaagttgacgctgtatttcgtctgccaataatgtttttggagatagcgcaggtgataagccatcatggtgatgtctgtccgccattctttctccagaccgatgagcactcccatgccgatggagtggacgcctgcctgccccatgcggtcgaaaccgttgacacgccattcaaatttggacttcatgccgcgggggtggtagatgttgtaattcgctttgtgataggtttcctgaaaacaaatcacaccgttcatgccgtgctctttcagctctgcatactcttccgcctttaagggcatcacttctattttcagattgctgaagtagggttttgccaggtctagtgcacgggctatgtagggcacgcctgctttggccggattttctcccgtcaccaacagcaaattctcgaaaggtgccagcttcttgatggccttgtattcgttcacgatttcttcttccgtcagtatggtacgcggcatggggttgctgatatggaaaccgcaatacacgcaagagttggtgcaggaattcgtgatgtaaagaggcacgaacatggagatggtcttcccgaatcgtgcctcggtgtatttcttgctcaatcgtgccatcgtctccagatagggagcagcggcgggtgagatgagggccatgaagtcctctacattacaatgttctttggagagggcacggcgtacatccgcatctgtcttggcatggatgcgtgccgtggtttcctcccaggatatatgttctaattcgtctgaaaacatagtgttctatcaattcccatttatttcttttttaattctctcgacaaccgcattgcacagaagtttggtccgcacatcgtgcaatactccccatccacatgcttccctgcatggaaatagctgaacgcacgttccgggtcgagcgacaagtcaaactggtctttccagcggaattcataacgtgctttgctcagtgcattgtcacgcacttgtgctccgggatgcccttttgccaggtcggcggcatgggcggctatcttataggtgatgacacctacacgcacatcctccttatcgggcagcgccagatgctctttgggggtgacataacagagcatggccgtacccagccaacctatctgtgccgcgccgatggcagacgtaatatggtcgtaacccggtgcgatgtccgtcacgatggggccgagcgtatagaaaggcgcatcgtggcatttttctatctggcgctccatattctccttaatcttgtgcatgggcacgtggccaggaccttcgatgaaagcctgcacattcttgtcccaagcacgcagcacaagctcgcccatcgtgtcgagttctgcaaactgcgcttcatcgttggcatcgtgcgtagaccccggacgcagcccgtctcccaaagagatggcaacgtcatactgtgccagaatgtcgcaaatgtcatcaaagtgttcgtaaaggaaactctcgcggtcgtgcactaggcaccatttgctcatgatgctgccgccacggctcacgataccgcacaaccttttctcggccagatgcacattatggcggcgtataccggcatggatggtgaagtagtccactccctgctcgcattgttcaatcaaggtgtcgcggtagatttcccaggtgaggtcctccaccttgccgttcactttctccaatgcctggtagatggggacagtacctaccggaacgggacagttacggataatccattcgcgcgtttcgtggatattctctccggtggagaggtccatcagcgtgtcgccgccccatttacagctccataaagccttttccacctcttcttcaatgccggaagtggtggcggagtttccgatattggtatttatcttcaccaggaagttacggcctataatcatcggctctgcttcgggatggttgatgttggcaggaagcagggcgcgtccggcagcaatctcccggcgtacaaattccggtgtgatgtgcgtctctattcccagctccgcgcagttcatgttctcgcgaatcgccacatactccatttcaggcgtgatgataccttgcttggcatagtacatctgtgtacagcattttccttgaagggcacggtagggcagggtgatgtgctcaaagcgcagagaatcgagtgacctgtcgtcgcggcgcatgcgcccgtactccgacgttatttcggaaagttgctccacatcgccgcgtttcagtatccacggttcgcgcaggcggggcagccctttctttaaatccacttcgacggcagggtcgctgaacggtccgctggtatcatacacatacacttcaagattcggggtaatcaccttttctccatctatgaagttcgtactgggcacttgttccactttacgcatagctacgcgcaattcgggaaacaaggtgcccggcaaatatactttctcggaacgggggaattttatcttctggttcattgcattgtcagttttataggttcaagaatgctgtcagcggtgagctggcttccgcaacaaaattatcggcttgtgcgcccagacctgcttcgtatgccatgcgtcctgcctctacagcctgcttgaacgctaccgtcatggccacggggtcgcccgctacggcaatggcggtattcaccaggcaagccgacgcgcccatttccatagcctctgccgcatggctcggggcaccgataccggcatccaccactacggggatattggcttgctcaatgattatcctcaagaaatcccttgtctgcagtcctttgtttgtgccgataggagcacccagcggcatgacggtggcggcacctgcctcttccagtctcttgcacagtgtggggtctgcctgacaatagggcagtactacgaagcccaatttgaccagttcctccgtggctttcaacgtctccacagaatccggcaacagatagcgggggtcggggtgtatctccagtttcagccagttcgtgccaaaagcctcacgcgccatctgtgcggcaaaaacagcttcttcggcattgcgcacgccggaggtattgggcagaagctgaatgccgggatgttgtatatgcaccagcatatcatcttccttattgtccagttcaattcgtttcattgccaccgtcaccatttccgtgccggatgccaagatggattgttccatcacttcgtcggaatggaactttccggttcctaaaaacaggcgagagttgaactcacgtcccgcaatcactaatttttccatgtcagtagtgttatattaatttttcgttctttactttttcccctgcttcttcattctttattaaagaaatgattctccgcatctcgtctgccggactatcggcatgcagcaccgtgccggatagggcaattccgctgactcccgtctgcataatggcgggaatgtctgcaatggtaattcctccgatggcaaccatgggcaggcatacgttctcctcccgcatccggttgacgatggcggcatagccttccaatcctaatatcgggcttaggttcttcttggtggtggtgtagcggaaagggccgcagcctatgtagtcggcaccagctttgtagtgttgctgtacatcctcaaaagtattggcggtaccgcctataatgtactccgcgcccagaatccggcgtgcgtcggctatgggcatgtctttctttccaagatgtacgccgtcggcacgcagcttctttaccagttccacatggtcgtcaatgatgaaggtcgcaccgtattgtcggcaaagagcctgcacctctaaggctacgggttctatcgtttccaccggggtgtctttcatgcgcagttgcacccagcggcaaccgccctcaagagccatgcgtgcagcatccaggtacgaatatcgctccgtatagtgcgtgatgaactgcattcctccgtttttcagcctctcgtccttcatcttcctcaccctccgcaagccgctttgataatgatgatggacatgtattccctcagggcgcattttgtccattccgtgcgaaatacaatatggttgtctacggccacggcaatgccttgcaccggtagggcaagttcctcgataagttgtgaaagggtagtggcgccggttttcacttccttgttgttgaccaatactttcatttttctgttcattaagaaataaaacaatggaagtaaatacaaagaagcgtctttacggcaagtttagtgaagaaaaaaatatccaattcctacggcagtactaactgcatcaggttcgagggtataatctcagcccgtcagggcacccctttgtctttacggcaacaaaggtaagggaaaatcggaaataaaaaacaaaaggaagctttttttctccctgtctctgacttttcttttccttaccatctccgtacctatacagacgtagcagatagagaagagattacaagaggaaagtaaagctctttaaaaagaaaggctgcctctccgaagaaagacagccttgaagatatactatacacaaagaattatgcaatcccgtgagccgttgcttccggtgcaattttcttgataagaccttgcagcactgcaccaggaccgcactctgtgaagtccgtagcaccatcggcaaccatgttcttcactgtttgcgtccaacgtaccgatgctgtcagctgagccaccagattcttcttgatttctgccgggtcagtatgaggcatagcgtctacattctgatatacggggcacttcggagcatggatttctgttgcattgatggctgcttccagttccactttggcagggtccatcaatggagagtggaatgcaccgcctaccttcaacggtaaggcgcgcttggcacctgcagccttcatcagttcgcaagccttgttgataccttctatggaaccggaaattacaatctgtcccgggcaattatagttggctgccacgcaaacttcaccttcggcacttacctgggcgcagatttcctcaaccttttcatccggcagggcaattatggctgccatagtggagggctgtgcttcgcaagccttttgcatagccatggcacgggcatacaccagtttcagaccatcttcaaagctcagtgcaccggcagcaaccaaagcggagaactcgcccagtgagtgaccggcggtcatctccggcttaaagtcatcgcccatgcagagggcggaaataacggaatgaaggaatacggcaggttgggtaactttagtctggcgcaggtcttcatctgtaccgttgaacataatatcagtaatacgatacccgaggatatcatttgctttctcaaaaagttccttggctaatgccgaattttcgtacaggtcctttcccatgccaacgaattgggcaccttgacccggaaatacaaatgctttcatatttactcgttttttagtgtttaaataaaaagtgctgcaaaggtagaggtttttctgatattcaccgcacaaacggatgttttttgtgcaatacccttactttaaggaggaagctaaaatacaatatgtatgcttgggtcttctgtgatatccggatactgaaatacttataaatgaaacacttcctccttattgtacttcctacaattagacctcttgtgtattcttgtaaattacatattgtattccatacgataacaactgaaaatgatattgtataaagtaagatatgtattcagttgaaaaataatgctttataacattgtaaaaatattcttttcctttgttgcaaattagaaaaacctatttatatttgcagcgcttaacgagatatattatgcaaaacatagaacaaaaaacgccgttggcaaacaatcatatctctgtggactgtgtagtgattggttttgacggagaacagctaaaggttctgctgattaagcgtgcaggagaggaagaaggagaaatctttcatgatatgaagcttcccggaagtctgatttatatggatgaggacttagatgaagctgccaaacgggtgttgaatgaattaacgggcctgaagaacgtcaatctgatgcaatttaaggcattcggttcaaaaaaccgtacgaaggaccccaaagatgtgcattggctggaacgtgccatgcagtccagggtggaacgtattgtcaccatagcctatctttccctggtgaagatagaccgcgcattgaaccgtgatttggacgattatcaagccagttgggtagccatgccggatataaaggctctggcattcgaccacaacctgattatcaaggaagccattacctatgtccgccagtacgtcgagttcaatccgtcttcactgttcgacttattgccgcgtaagttcaccgcatcccagcttcgcactttgtacgagctggtgtatgacaagcagtacgacgtacgcaatttccataaaaagatagccctgatggaatatgtcgttcctctggaagaaaaacagcaaggcgtggcccaccgggcggcacgttactaccgttttgacaaaaagatatacaataaaatccgacggtagccggattttgaattcttcatatcactttcattctttaatattgatagaaatgtatttattaggttatgacatcggcagctcgtctgtaaaagcgagtctggtaaatgcggaaagcggcaaatgtgtatcgtctgccttcttccccaagactgaagcggaaattatcgcagtgaagcccggctgggcagagcaagaccccggaaattggtgggaaaatttgaaactggccacacaagctgtattggcagaatccggagtaaacgcagaagacatcaaggcgattggtatctcttatcagatgcatggcttggtatgtgtagataaaaaccagcaggtgttgcgtcctgccattatctggtgcgactccagagccgtgccctacggacaaaaggctttcgaaacattgggagaggagacttgcctttcacatctgctgaattctccgggcaacttcacggcctccaaactggcttggattaaggagaatgagccttccgtttacgaaaagattcataagataatgctgccgggcgactatatcgccatgaagttgagcggtaccatctgtaccacggtgtccggtttgtccgaagggatgttctgggatttcaagaacaaccgggttgctgattttctgatggagtattatggattcgactcctctctgattgccgacatcaaaccgactttctccgagcagggacgcgtcaatgctgctgcagccgcagagctgggtctgaaagaaggtacgcctatcacttaccgtgctggcgaccagcccaacaatgccctttccctgaatgtattcaatccgggtgaaatagcttccaccgccggaacatccggcgtggtatacggcgtgaacggtgaggtgaattacgaccccaagtcacgtgtcaacacctttgcacacgtcaaccatactgccgggcaaacccgtctgggtgttctgctgtgcatcaatggtacgggcatcctcaattcatgggtaaaacgtaccgttgctcccgaaggcatctcctacagcgatatgaatctgctggcagcacaagctcccatcggcagtgccggcatcagcatcctgcccttcgggaacggtgcggagcgtatgctggagaacaaggaaataggctgctccattcatggcatcaacttcaaccagcacggcaagcagcatatcgtccgtgcagcgcaggaaggcatcgttttctccttcaaatatggaatcgacatcatggaacaaatgggcattcccgtgcagaaaattcatgccggcaaggctaatatgttcctcagcccgctgttccgcgagacattggccggtgtgacgggagctgtcatcgaactgtatgataccgacggctctgtaggtgccgccaaaggcgccggaatcggtgcgggcatatacaaggacaacaacgaagcatttgccacgcttgagaagctcgaggtgatagagccgaaagtggcagaccgccaggcttatgccgacgcatatgcgcgctggaaacactgtctggaagaagcaatgagataatgtatgattgattcatggcatcttgatatgaacaaatttttgcaacttatttaaatcaaataattaatcctttaaaacaaaattaagattatggcaacaaaagagtattttcccggaataggaaagattaaattcgaaggtaaagagagcaagaacccgatggcattccgttactacgatgccgataaagtaatcatgggcaagaaaatgagtgaatggctgaagttcgccatggcatggtggcacactctttgcgcagaaggcggcgaccagttcggtggcggaacaaagaaattcccctggaacggtgaggctgacaaggttcaggctgccaagaacaaaatggacgccggctttgaatttatgcagaaaatgggtatcgaatactactgcttccacgatgtagacctttgcgaagaagccgagaccattgaagaatacgaagccaacctgaaggaaatcgtagcgtatgccaagcagaaacaagctgaaaccggcatcaagctgttgtggggtaccgccaacgtattcggccatgctcgctatatgaatggcgcagccactaaccccgattttgatgtagtggcacgtgccgccgttcaaatcaagaacgccatcgacgctactatcgagctgggaggttcaaactatgtattctggggcggtcgcgaaggctacatgtctttgctgaatacagaccagaaacgtgagaaagagcacctcgcacagatgttgaccatcgcccgcgactatgcccgtgcccgcggattcaaaggtaccttcctgattgaaccgaaaccgatggaacctaccaaacaccagtatgatgtagacaccgaaaccgttatcggcttcttgaaggctcacaatctggacaaggatttcaaggtgaacatcgaagtgaaccacgctactttggcgggtcacaccttcgagcacgaactcgcagtagccgtagacaacggtatgctcggctccatcgacgccaaccgtggtgactaccagaacggctgggatacagaccagttccccatcgacaacttcgaactgacccaggccatgatgcaaatcatccgtaacggaggttttggcaatggcggtacaaacttcgatgccaagacccgtcgtaactccaccgacctggaagacattttcattgcccacatcgccggtatggacgtgatggcacgtgcactggaaagtgcagccaaactgcttgaagagtctccttacaaaaagatgctggccgaccgctatgcttccttcgacagtggtaaaggcaaggaatttgaagatggcaaactgacgctggaggatttggtagcttacgcaaaagccaacggtgagccgaaacagaccagcggcaagcaggaattgtatgaggcaatcgtgaatatgtactgctaataatgatcaatgtttagtgattagtggttaataggttgcgcatgaagtgtttcaatattaatcattaatcgctaatcattaatcgctaatcattaaccattaatcattaatatcatgaattatacagaaaaaggcagtaaactctacctcttctctattgtgttggtagccgtcattggaggattgcttttcggttacgatacagcagtcatatccggtgccgataaagggcttcaggcattctttatgggtgcccccgattttgtctacacagatacgattcacggcattacctcttccagtgcacttatcggatgtatcatcggtagtgctctttcgggattcttcgcatccaatctgggacgtaagaattctcttttcatagccggcgtcttgttctttctgtcggcattaggctcctactacccggaattccttttcttcgactatggtgttccttcctattccttgctcgtggcattcaacttctaccgtgtattgggaggaatcggcgttggtttggcatccgccatctgcccgatgtatattgcggaaattgcgccgagcaacattcgcgggactctggtatcatggaaccagtttgccattatcttcggccagttagtggtttacttcgtgaatttccttattttgggcgagaattcaaatccggtgataaaggccattgaaggagtcaaccagattctgaatcccgaagcggcagcatggaccacagagataggatggcgtctgatgtttgtcagtgaggctgttcctgcaggagtctttgcgttgctcgtactgtttgttcccgaaacgccacgctatcttgccatgagtggcaaggatgataaggcactccaggtgttaagccgtatcaacggcttggctcaggcaaaggttattctgtctcaaatcaaagccacggcagaggaaaagacggaaaagcttttcacttatggctggatggttatctttatcggaatcatgctgagtgtattccagcaagcggtaggtatcaacgccgtactctatttcgcaccgcgtatcttcgaaacgatgggaatgggcaacccgatggtgcagaccgtcattatgggtatcatcaatattctgttcacgttgctggctgtctttacagtcgagaaatggggacgtaaaccactgcttatctcgggatctatcggtatggcgataggtgctttcggagtagctctttgcaacgttgtggcagggcttcctcccatgttggctgttgtcagtatcatggtctacagtgcttcgttcatgttcagctggggccccatctgctgggtactgattgctgaaatcttcccgaataccatccgtggcgctgcagtagccattgccgtagcctttcaatggatattcaatttcattgtatcttccaccttcgtacctatgtacaatatgagtttgggagatatgggagacaagttcgggcacatgtttgcttatggcttatacggaatcatctgtgtggtggccgctctgtttgtctggaagcttgttcccgaaacgaaaggcaagacactggaagacatgaccagactgtggaagaatagaaaaaataatagataagaacgttattgaaactgtccatataaaatgagaaagaggttgtgtcaaaatgctgacacagcctttttttatgcgcaaagcccagacacagtttttttgtccgatagtaaaacaaatgtcagaacaagtcttgactattacaatttatctataacttggataataaacgttccaagaccttttcattgtgtgctttccaatcaattctattctcttgtaaagattttccaaagccttcattagaaggtacacttaaatccttaccactatcttcataagcataaaaagggaaacatcccatccatcctgtttcttgtatcatttgattaaatgtaccgtaatcatactcacctgatttaaattccacatatattttactttcaccattataagtaataatatgtgtgcttttatcatacgaaaaacaacgttccgtattattaagtaaccatccctgaaattcaacaccataatgacaatgcaattcatcataaaacatctcctcttttttataacgagcgcatttaattgttccccacatctcctcacctcctttataagatactacgaccaacaaccaaagttcatgtaaacgaaatatagtaattttatcaatatattcatcaaccatagtctttaccaaatccctatttttcctaatctcatccattttattaatcaacaaaggattggcattcaaacgcttcaaattatcaatagtaattctctttgttgtaatttctcgtgacaatttatccatagttttgttcaacacgtttttagtttcatcatatttatgttttgcatctgaaatcaaattctttgcaacctcatcgtcttcaatcgcaataagacgtttaagtgtctttttataaagattctccgcttcaaccaattctgtattctttgatgattttatttgaaccaactcttcgatttctttccctaaattttctatctttaaaatattggtctgctgaatattaatctcagcaaacatttgaattgacaactgtaaaacaagtccatccaatttccactgtcgaagttctgccccattcgtgcatgttcgtggtttatctttacgattcactctaccataacatttgtaagtacgtccaccactgatataatttttagatgtttcatttgatttccctacagaaaaattagcaccgcattcgccacataccattaaatgttttaataaattctcatgcctgactgcattattcttattataatgcgctttggaaagtttatcttgggcttgctgaaacaactcgtctgatacaattcgcagactttccacatgttccgaatattcataaacaatctctctatcttgcctttcggataacggaagtggattggtagggtctggtttataaaatgttattctacgattacctttatataactcattgtgcataagtctgtttattgtagaaatacgccattttaaattatctgtatcaaatttatactctttcacctccaatccttttgcttctctattcttcttgtactcattcaattttcttacgtatggagcaggtactttctcagcattcaatatctctgatatttgaattgaagaatatccaccaacatacatttcaaaaatacgggtaacaatcttactttcgataggatttataacaatctgtttattttcattgtgcatataaccatacgcacgttcatccccgcctccatgacctgcttgcacttttgttatcttgccacttaatgaacgttcaacaaacaattctatctcatagcttgacataacagcaagcacatgcaataaaataatactacctacatctttattactatctcttacccacaatttttgtttatcaaaatacaagttaatacctttatctataaacaatttgatttgttctaataactccgtagcatttcttgcaagacgagaaaattcagagaataaaattatatcaatatccccatattcaactctttcaagcatcttcacatattcaggacggaactctccctttttaaaaccactaataacatctatgaaaatatcctcttcttcaacgttccaatgattttctgctgcaaacttcaacaattcctctttttgtctatcagttgtctgttgttgcgtactaacacgacaatagattagtaccttcttatccatattattcattatctttgcgctgttaattacatcaatatcagtttatatggaaacaaatatagtaataaataagccaagtcccaagtttcaggatgtgtcaattgcacctatgcatacaacggagcacatcatcaaccagactatgataaggttattcggttgcagccgctccatatcagcacacatagaacggaagaaaagcaagctggactaccgtcttgccgcctgccccacggaagaagaaatagagaagctggaagaggccgtaaacgaggtaatcgcccgacagctgcccgtcacaacagaattcattacgcaagaggaagcgcaaggacgtttcgacttggaacgcctgcccgatggtgcttcggaaacggtacgtgtcgtgaaagtaggcgattacgacgaatgcctctgcatcggagtacatgtggagaatacatcagaaatcggaaccttcaaaatcatcagtcacgattgggacgaagaagccaagcgttggagaatgcgttttaaattagtctgaaaatctatcaattttaaataaataagatagcaaaatgacattaaacaagcaaataagtcagtttttcaatgacaaatagtcaatagagtcagcaaagaccggttggcataaggtttgcaatatagttagcgaacgacggttcaagaaacggatggtgaaaaacccaaaaggcaggcacccgaagacaaagaaccggagttcaaaactaaatagcatgtttaacttaaacaataggagactataactatgatgcctgtaagaagaaaccaaaattggttaccgagtatttttaatgatttctttgacaatgattggatggtaaaagcaaatgccaccgcccctgccatcaacgtattcgaaacagcaaaagagtacaaagttgaattggctgctcccggtatgacaaaagaagacttcaacgttcacatcgacgaagaaaacaatctggtcatcagcatggaaaagaaaacagaaagcaaggaagagaacagcaaggacgaaaagaaggaaggccgctacttgcgtcgcgaattctcatacaccaagttccagcaaaccatgattcttccggacgatgtagacaaggaaaagattggcgcccatgtagaaaacggcgtgttgaacattacattgcctaagtttacagaagcagaaaaagaaaaggccaagaaattcatcgacgtaaaataacgcccggccattaaaaagaaaatctcccgctgcacaagataatgcaacgggagattttttatatccatagctatgcggaactatttctttttccctttcagaaaacgatctgtcagccacttgcgcaccggttcgtcgtacagtttcaaacaagcataagcaagaacaaaagctccaacgaaagtaagcatcatataagggatgccttccaccattgtagcgttattgttgcatacccaagccgtataagtatataccaatggataatgggtgatataaatcggataggaaatatctcccaggaacttgcatacggcagtagagcgcttaccggtcaccttgccgccggctcccatcgaaacaatgaccgggaagatgcagataatacagaaagcctcgtaaagcccgttcatccagtagccgtcctcacctccgatacggggaagggaaagaaccaccacaatcagcaggctacaccaccagaaagcacgcttttcaagccgtatcagccagccgaggcgtgacagaagcaatccgccgaaaaacggatacatcagccggaccatgcccacatactgctgttcccagttcaaggcccaaccacccacaatatcaccagcaggagcagtcagacaacggtacaccgtaaaacaccctgccacaaataccagcaccgataaggccaccttattgaacttgcgtacaaacaacgcatacagaatattaccgatatattcataatagagcgaccatgccggaccattcaacggatgcatttccgtccagccacgaatgtcgaacttcagcggaaggggaagcaaagtacagcctagtaacattaccagcagcatggttccaacagacgtattctcgataggtggaaaacaaggcgactcttgaaaatagaaaaaggcagcgcccacaatgcttcccataatcaccataggatgcaggcgaatgatacggcgtttgaagaaagtgcccacggtcatccggttccaacggtcatcataagcataaccgataacaaaaccggagagcatgaaaaagaaatccactgccagatagccatgattgataatttgagtaagatgactgccgcctgcatgtgcttcaaaaagatggaagataataaccatgacagccgccacgccacgaagtccgtcaagaatctcataatgcggtttcgaggcaagataagtagtctgtgtattcattttggtataagatatttatttattcgcgtgcaaagataagagttttctccaataatgaaactgataaatatcatataaactctatcaattaattgacaagtataacagttgtctttatcattagatacatatcactacttgtactctttttccgcacaaaaaacagcttttattatccataataaaaaggctacaccttttcctcctcatggcgtagccttaaacacaaaagggtgtagctatccaaggcaaatggtgtagccctttttcaagaaaaagagccaaatgggatgctaatatggaaaaatcagttaactgcttttcttataactttttaccgcccacagattgaagaccaatgcaaagaccaacaaggctcccaactgcggcagcagttcggcaaatccgccgccacggagatagatggtacgcattacctctacaaaatagcgcagcggattgatacgcgtaatccattgcgcccactcaggcatactgtggataggggtgaaaagaccactcatcagaataaggataagcatgaagaaccacatgacaaacatggcctgctgcaacgtggtcgaatgattggatatgaccagcccgaaccccgacaccaccggtagaaaaaacagcaccatgccgtagatagtgaggaaatgtcccgccggcagaatgccgtaaagtacccatgccagaacgaaacagatggtcagcaccacaaaacctatcagccagtaaggtatcagcttggcggcaatgaaagtgaacttgccgacgggggtgacatttatctgctcgatggtgcccgcctccttctcgcccaccacattgagggcagggagaaaaccgcaaatcagcgtcagcagcattaccatgagggcaggaatcatgaaaagcttgtagttcagcgtggggttgtaaaggttctgcgtagtgatgtccacccggggaagcggcttcccggcaagcccttgcgaagacgactccgaacccagttcacgggtatagtcactgatgatggaagacaagtaggatcctcccagactgcccttcgtgccgttcacggcattggccgccaccagcaggcggggcgcctctcccttcacccaatccttttcgaaatcacggggaatctccagcacgacatctgccgaacctgcttcaatggccagcaaagcctcatcatatgtatcgggaagcgctgtcaggcggaaataagtggatgcaccgattttatctaccagacggcgagacaagacgctgtggtcattgtccactatattcagattgatgttctttatctccagattggcggcccagggcatcagtatcataatcatgcacgggaaaatgaaaatcagcttgggcaggaaggagttgcggaacaactgcttgaattccttttcaatgagaaactttatcataagacgatattttaaagattttagacataagaacaaaagaacagatttcccgtatccttttgtccttatgttcttctgcctgaataattaatataaaattcatatccgctctttactcaagccgatgcttgaatttcttgaaactcaccgttatcagcaataccgccatcgtggcaagtatgccgacctccatcagcacaagcgaaacatccactccctcaatcatcagcttacgcaccgcctggatataccagcgtgcaggaagcacagctgaaatggcctgcaagataacgggcatactctcaatggggaatatcatgcccgaaagcaacatggtgggcatcatcagcatcagtccggacaccagcatggcggcaacctgcgtccgggtgaccgtggaaatcagcagccccagcgccagggagacaaaaatgaatagcagcgacaccaccaccagccagaacaagctgcccgccacgggaacatcgagcacatagaccgaaagtagaagaatggtggtcaagttgacaaacgacagcacaaaatagggcaccgcctttgccagaatgatgaaaagcggtttgacgggagaaaccagcaggacctccatcgtccccgtctccttctcgcgcacaatggagatggaggtcatcatggcgcaaatcagcatcagaataagtcccatgacacccggcacgaagttgtaggcactcttcatctgcggattgtacagcagcttgagctggggtacaatggcagcggcatgcactcccggcggaagcatctcctgcccggcagaggagatgatgtttgcggcatagcctgcctgcatagtcgccatattggggtctgtggcgtcggagacaagctgcacgcgcgcctcgccggtataaagcttgtccgagaaacgctcgctgaaaacaagcgccatgtcaatctcccctcttccgaaagaagcctccatatcggcgggagaatgcaggcggcagatgacggtgaagtattcgcttgcatccatgcggtcgatgatacggcgggtaactacgtcattcgacgggtcgagcaccgccacacgcacgttcttcacctcggtggtgatggcaaaaccgaaaaggattatctgcacgatgggcatgcccagcagaatcagcatcgtgcgccggtcgcggaagatatggaagaactcttttcggatgaaagatatgaattgtttcattgtctatatttatatttaggctcggataatgcggatttcacggattctcagtcggcggttcgcacggcttggcgagccagttgttggaatacatcgtccatcgtagtggcattgaactgccgtttcagctccccgggagtgtcgagtgcacggatgacgccgtctaccatgatggagatgcggtcgcaatactctgcctcgtccataaagtgggtggtgacaaagacggtgatgccctcgtcggcagcctggtaaatcagctcccagaactggcggcgcgtggcagggtccaccccacccgtaggctcatccagaaagacaatcttgggacggtggaagatggagacggagaaggccagcttctgcttccagcccagcggaaggcttttcaccagtgtatcccgttccttttccagcccgaggcggaggagcagttcatccgtcttgggggcaatctccgcttcggggatgccgtagataccggcaaagaggcggatattctcccacaccttgaggtcttcgtaaagggaaaatttctggctcatgtagccgatgttcttcttcacttcttcaggttgggaagccacatcgaaacctgccacacatgccttgccgccggtggggcggctaagtcccgtaagcatgcgcatggcggtggtcttgcctgccccgttggctcccaggaaaccgaaaatctcgccccgatggacttggaaggagatgtggtctacagcggtgaaattaccgaaccgcttggtcaacccttccacttcaatcaccttgttttcgtggttttccacccgttcgtgctgcaagcccggagggcagaggatgcccgcaaagcgtgtcaggatacggtcgggggtatcgatgccttttatctctccttcgttgatgaaggcgatgcggtcgcattggcgcgcttcgtcgatgatgggggtggaagcaatgatggtgataccctgctccttcagtcggcgaagcattccccagaattccttgcgggacacggggtcgacgcccgtagtgggttcgtccagaaagaggacatccggtttatggataagggcacagctaagggcgagtttctgcttcatgccgccggacaacgctctggcgcggcgcttgcggaaaggttctatctgccggtaaatgtcgcgcaccaaatcataattctcctcgatggtggtgtggaagacggtggcgaagaaattgagattctcctccaccgtcaagtccggatagagggagaagcgtccgggcatataccccacccgcctgcggatggctttgtagtccttcaccacatccagaccgcagaccgaggccgagcctccgtcagcaagcagcaaagtggtgaggatgcggaaaagcgatgtcttgcccgcaccgtccggcccgatgatgccgaaaagctcaccgggagccactgacagagagacaccccgcagggcttccacgctgccgtaacgtttggagatattagttaaagttacagcctccatacattcctattttcagcatcccgtcattcttcacggcaatctttacggcatagaccagattggcgcgctcgtctttcgtcaggatagtttttggagtgaattcggacgtatcggaaatccaggtgacgatgccggggtattctttccgcacttcctttccataatccgcataaaccttcacttgctgccccagcttgatttcggcaagctgctcggaggtgatgtaggcacggaggtaaatctgctccatatccgccactttgaaaagaggggtgccgggagcagccagttctccggcttcggcatattgggcaaggacggttcccgtcagcggagaggtgatgtggcatttgcgcagctggtcttctatctgcgccacctggatgccgacagaggagctttgccacgtcaggctgcggtcactgttgcgcagggtggagttctgtgcgtcgagctgcttgcggaggacttcgagaagggactcggcatcatcgagctgcttctggttggcggcacccacacggagcagattggacacacggtcgcgttcgcgtcgagcctgcacaatctgttcctgagtggcggctacttgtttcaggatatcaggccgctggccttccacggacttgacactggcctccaactggagtttcttcagatagagttggacggtatctataatgcctacttcctgcccgtctatcagtgtcgtgccttcctcgatatcgaaactcagcagttttccagacgcctcggcagaaacgatgacttcggtagcctcgaacgttcccgtcgcatcatatttcggagtaccgccggtacaggcggcaaggagaaataaaaaaggaaataatttcaatgatttcatactatttcaagttataaattacggattatagtcattaattattcagcgtatatttcagctgccagatgttcatcagcaactgcacctcatgcaatgccttggtctgtcgtgccatactttcattggtaatctcccgcagcatatcggtcacggtcattgtcccgttctgtaccttggcctcggctgcacggcggatattcccacgcagacggataatctcgtcatcatccgccatctggcggcgcatggatacaatgcccgcatcctgctgcgtagcctgcaggcgaatgttgaaaaggaacacatcccggccggtctctatctgttggcgggtattgtctatcctgcggcggtcgttcttcaacgtatacagactgccgaaattccagaacatgcgcacccccgccatgtaataggcgttgaattcatctttcagcatattcaatcccggattgccgtatgccccttgtacaaaaaggccgaaacgcggcatcaaccgggtgttcaaggctgcctcctgctggtggagttgctctccctgcgcatcgtaccaacgaagttcggggcggttgttcatctgccggtctatgttttcttcggcagccggtttcaataaaaccgtttcggaagagagatccttgcccgtaaaggcagcaagcatgctgaggtatgcacggcgggtggtctccaattccacacggtgctgcctggtgttcagttgctctacgctgactgcatccaggtcgctcagggtggcgatgccattggctatatagtcggctacctgcttgtgggttcttcctaaatcttcttgcaagaggctgttctgtttcagctgttcgtccaacagcaggatgccgaaaaagagctggttcacccggtcagtcaaggcatacatgtctacatgctgtttttccagttccacttccgaggcggcacgcgtcaatcgttttctggaacgtatatccccaccatcccagagggtctgctgcacttcgagcatcacctggtactggtctttcgaagcagtcttgatgtcgagattagggatttcgaccggtagccgggtgatgtcactctggtacgtggccttgccggatagggaaaactggggcaagtaaccttttccggcattggagaggtcgtacccgcgtgccttttctatcagtccgtattgcctgaccaacggataattgtcttgcgcccggcgctggcactcttccaacgtgagctgggcatgtgccagcatggcggcaagagaaagggtaaaaaagaaaacggttcgtttcatatccattctgtttcttgtttattctacatggttttgttctatacacatgcaaagataaaggcataaccctataaccttacaatccatttgtgcgcaaagatgttctaatagtacgacatttcgtagaaaaagacaaataataggaacactttattatctttgcggtggaaatatacattattcataaagggaaagatatggaaaagaacaaaccgataagcgtcgcattcgaggacatccgcaacaatccggattttatagaacattccgaatacagatttataaacgacgatttgggaatggtcatcagttttcaagcaatgggattcaggctattccgcacccagcaaccttatcgtgccaaagaaggaaggattgtacgcatcatgcaaggtaagggccgaatctccatcaatcttatcgaatatgaagctacagcccacgatattattatcatccctgacaattcgctgatagaaatatcggaagtcagtcccgactacgaattccaagtcatcatgcccactgccaattttctgcccgtactacagaattccattctttcggaagcttatacacgaaacggaatccgcctttcatgcaacaacgaggaatgggcacacatcagcagcttcttctctttattgtggaatatactacattgtttgccctaccgccgcggagctgtacagcacttgattgtctcacttctctataaccttaagtatatccacgagcacacatgcaagtcaactccggcacgcctttcacgccaggaagagctattccgccgcttcatcgctttggtaaaccaacacagcaagcacgaacgcaacgtcaacttctatgccgacaagctatgcctgacaccgcactatctgagttcggtgatacgtgaaacaagcgggcaaaccgtgatgcaatggattaatcaagcagttatcctcgaagccaaagtattgctgaaacacagtgatctgctggtgtttcaaatatcagacgaactgaactttcccaatccgtcgttcttctcgaagttcttcaaacgtatgacggggatgacaccggcggaataccagaaacaaacctgaccttagaacaattgtactacacgagaattcggcaatccatcgcaggagtctgcttccaatgccagcagcccttgttttgctgccagtccaccggcatagcctatcagttgacggttgctgcccaccacacgatggcagggaatgaatatggagagggcattcgccccattggcagccgctacagcccgtacggccttcgggttgcccaactttcgggacagctcgccgtaggacaccgttttcccgtaaggaatattcagcaactcctgccataccgttttctggaaatccgtccctgccaacagtaacggcatgtcgaacgccgtccgcttacgggcaaaatattcatccaactgaatgattgccgttgaaataacttccgaagtgccctcctcataaacggcatgcagcgtattccgcatccgcctgccgattttctccttgcgcttttcgcttacccagtcgcacagacaaagtttgtctcctaaagagccgagcatcaactcgccataaggagaccgataatgctgaatccgaattgtttccataaacttgcttttttgtatatttgcacttccgatgcttccgacaaaaatagatatttatatccggatgtacaagatagaacatattataatacattccgaccttttccatttgacagtatcggggtatatttgtaaatatataaaaacatatgattaaataatatacaatgaaacagttctattggcttatagtaggcatttccctactctcactggcttcctgcaagggaaaggtcaagatggcaagagactgccagacagtgaaaatagatacagttatttcagcagacgaacagacctatctgcaatatccaggcaaagtgaaagcagcacaggatatcagccttgctttcagagtcagcggaaccatccagaaaatatatgtggagaacggtgcacgcgtaagtcagggacaactgctcgccgaactcgacccgacagactatcaggtgcagttggatgccacagaagccgaatataaacagataaaggcggatgccaaacgggtgatgtcactttacaaagactccgtcactacttccagcgccaacgacaaggcggtatatggattaaagcagattgcagccaaataccggcaccacaaggaccagctcaactacaccaagctctacgcccccttcaacggctttgtacagaaacgtctttttgaggcgcacgaaacgataggcgccggtatgcctgttctctccataatcagcagcagtatgcccgaagtggaaatcaatcttccggcagcggaatacatccggcgcggacagttccacagctattactgttcattcgatgtctatccaggcaagacctaccggctgaaactgataagcatcactcccaaagccaatgccaaccagctctataccgtacgcctgcaactgcttgccgacaagcagcagcccgtaccctctccgggaatgaatacgatggttaccatccagtacgacgaagagaattcatgccaactgtccgttccgagcggcgccgtactgcaaatagacggaaaagcgcaggtatttgtctacaacccgtccgacaaccggattaccgcccgcgaagtgaccctccttcgcctgacaagcaatggtcgcagcctcatcagctccaaccatctgaaaccgggcgaactggtcgtgtcttccggagtccaccacatcaaagacggagaaaccgtaaaaccgctcgccagaaccagcggaacaaatattggaggactattgtaaccactaatccctaaaaaactatggatataagtaaatgggcatttcagaaccgtaatctgatatacttcctagtagctgtcctgctgctgggaggagcttattccagctatgagatgagcaaactggaagatccggaaataaaggtgaaactcgccatggtagtgacaccctatccgggagcctcggctcatcaagtggaactggaagtgacggatgtactggaaaagagcatccgcagcatgggccacatagacaatgtggaaagttactcctacaacgacctttcactgatacagatagagttgacaacaaccacccgagacgatgaggtggaacaatgctgggacatgctacgccgcaaagtgaacgatgcccgtgcctcactgcccgacggggccggtacacctatcgtcaaagatgatttcgggaatgtatatggtatgttctacgcactgaccggcgacggcttgtccgatcggcaattgtccgactatgcggaactcgtgaagcgggaaatcagcgacatggaaggaattgaccgggtggaactctacggaaaacgctccgagtgcatcaacatctccctgctgcaagaccgcatggcaaatttgggtgtgaaaccagctgaggtgcttgccaccctgaacgggcagaacaagaccacttacagcggctattacgacaatggtgaccaccgcatccgtgtaactgtaagcgacaaattcaagactgtggaggacatcggcaacatgcttatacaaggacatgacgacgaccagctccgcatgcgcgacatcgcacagatagaaaaaggatacgaagagcctacccgcaacgaaatgttcttcgacagcgaacgggcacaaggtatcctgattgccgcctccagcggaacagacattgtgaaagtaggcgctgaagtagaaaagaggttagcacagctcaaagaaacccgtctgcctgcaggcgtagactgccataaggttttctaccagccggaacgcgtcggtgcttcattggggacattcatcatcaacctgatagagtctgtcatcatcgtagtgctcattctgatggtggctatgggattcaaaagtggggtcattatcggaatcagtctggtggtcaccgtcttcggttcatttatgtttctatatacggcaggcggaacaatgcagcgtgtatcactggccgcatttgtcctcgcaatgggtatgttggtagacaatgccatcgtcatcattgacggcatactggtagacctgaaagccggaaaaaaacggatggaagccatgacagccatagggagacagacagccatgccgctgctgggagctacgctgatagccatcatagcttttctgcccatcttcatgtcgcccgacacggcaggggtctacacacgtgaccttttcatcgtcctggcagtgtctttgctgttaagctgggtactggcgttggttcatgtaccactgatggccaatcggtatctgcatcctgccgtcgaaaccaacgccacaggagcgagagaatacaaaggacgcacttatgctgtcttgcgcgccgccctgcggatgggactggcacaccgctggagctttgtgttgacaatgctcgtcctgctcggactgtctgccttcggctaccagtacatgcgccagggattcttccccgacatggtttacgaccaactatatatggaatataaactgcccgaaggcaataactccacacaagtggttcaagacctccgggagatagaagcatacctgaaaacacgcaaggaagtgacgcacgtcaccacttccataggcggtacaccgggacgctacaatctggtaaggagcatcgccaacccgtctttggcatacggcgaactgattatagatttcacttctcccgaagagctggtagacaacatggacgagatacaaagctacctgacgcatcattatcccaatgcctacgtcaagatgaagcgctacaacctaatgttcaaaaaatatcctatcgaagtccagttcatgggaccggaccctgccgtactgcaccggttggcagacagcgcccgcagtatcatggagaacacgccggagatatgcctcatcaccaccgattgggaaccgcaggttccggtactctccatcgagtacgaccaagccgccgcccgtactttggggttgagccgcaatgacgtaagcttgtcactgctctcggccaatggaggtatccccatcggattcttctacgaaggcatccatcgggacaatatctacctgaaatgcctggacgaggaaggacaaccgatagaggacctctccaatacgcaagtgttctcctcgctgccatcgctgaacggactgctgaacgaagaaacaatggtaaagctgaaagccggtaccctctccaaagaagagctggtggaaagtctgatgggcagcactccactgaaacaaatcagcaaaagtatcgacatacgctgggaagacccggtagtgccgcgctacaacggacaacggagccaacgcgtgcaatgctctcccacaccgggcatagagacggaaaaggcaaggcaggccatcgcacggcagattgaaaggatagagcttcccgagggatacacactgcagtggcagggtgagaaaagcgccagtgaccagtccatgaagtatctgttcaagaacttcccactggccatcatcctgatgattgccattctgatcatgctgttcaaggattaccgtaaaccgcttatcatcttctgctgcattccgatggttgtggtaggcgtggtagcagtgatgctgcttacgggaaagacattcaatttcgtggcaatcgtagggacactgggattgatagggatgctcatcaagaacggcatcgtactgatggatgaaataaccttgcagattaatcagggagtggaaccgatgaaagccttgatagacagttcacagagtcgtttgcgcccggtatctatggcggcgctgactacaattctgggcatgataccgttactgcccgatgccatgttcggctcgctggcagcttccattatgggcgggctgacattcggcacactgataacgttgctgttcataccggtactgtatgcgttgtttttccatattaatacacaagactgacaaggagacaagggaaaaaaagacggcacattttttcttctctcccttgtccttctgtttttctgtccgaaaaatatttatcatttatattccgcccacgacttgatggccaaatcatccggcgtcatcgtgcagaatgcattgatgaacgcacttgccagacgggcattcgttatcaacggaatattgaggtcgatggcggcacggcgtatcttgtagccgttatccaactcgcctgcggtgaggttcttcggaatattgacaaccatgtctatctccttgcggtgcagcatgtcgagtgcctgcggctggcgttcgggttcgctgggccagtagacgcgcgtattctccacaccgttctccgtaaggaagttgctggaaccacctgtggcaaatattttataccctttctcctgaagcatacgcgcggcagaaagcatgtccactttctgcttcggagtaccggtagaaagcaggatattcttctccggaatgcggtagcccacggagagcatcgccttgagaatggcgcaggaagtatcgctgccgatgcaacccacctcgcccgtacttgccatatccacccccagtaccgggtcggccttctgcagacggttgaaggagaactgactcgccttgatgcctacataatccaaatcgaacagattcttgtccggcttctgcaccggaatgccgagcatcaccttcgtggcaagttcaataaggtttatcttcagcaccttgctgacaaacggaaacgaacggctggcgcggaggttgcactcaatcaccttgatgtcgttctcgcgtgccagatactggatattgaacggaccggagatgttcagctcacgggcaatctcgcggctgatgcgcttgatgcggcgcaccgtctccacatacaacttttgtggcgggaactggatagtggcgtctccggaatgcaccccggcaaactcgatatgctcactgatggcatatgcgacaatctcaccgttttgtgccaccgcatccatctccacctccttggcatgctcgatgaactggctcaccaccacgggatgtttcttgctgacattcgctgccagcttcaggaagcgttccagttcctcccggttggagcagacgttcatcgcagcaccggacaatacataggaaggacggaccaataccgggaaacccaccttatctacaaaagcgttgatgtcctccagggaggtcagcgcccgccattcgggctggtctacaccaatgcggtcgagcatggcggagaacttgtcacggtcttcggcattgtcgatactcttggcgcttgtgccgagaataggtaccttctgcgcatcaaggcgcagggcaaggttattcggtatctgaccaccggtagagacaatcaccccgtggggattctccagttcgagaatatccatcacgcgctcgaaggtaagttcgtcgaagtaaagacggtcgcacatgtcatagtccgtagacacggtttcgggattgtagtttatcatgacactgcggtagccttcttgacggatggtgttcagggcctgcacgccgcaccagtcgaactctacggaagaaccgatgcggtaggcgccggagcccaatacgacgatggacttgcggtcgccgaggtaacggacatcatttgccgtaccgctatacgtcaggtagagatagttggtctgtgcgggatattcggcggcaagggtatctatctgcttcactacgggcagaatgcctgcactcttgcggaaattgcggacggcaaggatggcttcttcgccgtccattgcttgttccaagccgagggcacgggctatctggaaatcagagaagccttgtaccttggctttacgcaataagtctacgggaatcattggcaactctccatcagccataaaagagtgcagttccctgctggtatccatgatattcatcagcttttccaggaaccaacggtctatcttggtcaattcgtgcacctggtccaccgtatatccggcacggaaggctttggagatgacaaagatacgcttgtccgtcggttcgcgcagagccttgtccaaatcggcaatcaccagttccttgttctccacaaagccgtgcatgccctggcctatcatacgtaagcctttctgaatagcttcttcgaaagtacgcccgatagccattacctcgcctaccgacttcatgctcgaacccagttccttgtccactccatggaacttgcccaaatcccaacgcggtatcttgcagaccacatagtccagagcaggttcgaagaaagcgcttgtggtctttgttacggagttgttcaagtcgaacaaaccatagcccaagccgagttttgccgccacaaatgccaacggataacccgttgctttagaggccaatgcagaggaacgactcaagcgtgcattcacctcgattacccggtagtcctcgctcatcgggtcgtaggcatactgcacgttacactctcccacaatgccgatgtgacggataatgcggatagcgagttcacgcaatttatgatagtccgtattgctcaacgtctgtgacggggcaataacgatggactcgcccgtatggatgcccagggggtcgaagttttccatgttacagaccgtgatgcagttgtcaaaacggtcgcgcaccacctcgtattccacttccttccagcccttcaacgatttctccaccagcacctgcggggagaaggagaaggctttctctaccagcacattcagctcttcttcattgtcgcagaagcccgaacccagtccgccaagcgcgtatgcggcacggacaatgaccggatatcccagttcccgggctgcgcgacgggcatctgccgcattctccacagcttcgctcttgatggtctttacatcaatctcattcagtttctgcacaaagatttcacggtcctccgtgtcaatgatagcctgtacgggagtgccgagaaccgtcacgccgtacttctcgaaaatcttgtccttgtagagggaaacaccgcagttcagtgccgtctgtccgccaaaagcaagcatgatgccatccgggcgctccttctctatcaccttctccacgaagtaaggagtgacgggcaggaagtaaatctggtcggcaacgccttccgaggtctgtaccgtggcaatgttcggattgatgagaaccgtgtagataccttcctccttcaatgccttgagcgcctgcgaaccggagtagtcaaactctcctgcctcaccgattttcagtgcaccggagccaagcagcaggactttctttatattgttttctttcatttgcatatctgtttattaaaaatgtaatagtagtaataaaaccttatctttctcttaccttacacaatcagtcactaattgaatggcattcagtataggactgaaaggcattcactctgggactgaatggtattcagtatgggactcattataccgtcttttttgcatactgattatcaagagattacgaacgctgccattcttgataaaattctcttactaaagcaacttcacaaagtcatcaaaaagaaactccgtatctgtcggcccgctggcagcttcgggatgaaactgtgcggagaaccaggggttgcgtttgtggcggatcccttcattagaaccatcgttcatattgatgaaaagcggttcccagtcttctgtcagcgtgttgttgtctacagcatacccatgattctgtgaggtgatgaagcaacgttccgtacccaccatgcgcaccggttggttatggctgcggtggccgtatttcaatttgtatatcttggcgcccccagctttggaaagcaactggtttcccatacatatgccgaagatgggcagtttctcgttctgcattgccttgcggatatgctgcacggcagcatcgcaggtatcagggtcaccgggaccgttggagatgaacaacccgtcgaactccattccagtataatcatagtcccaaggaacgcgaatcacttccacgtcacgtttcagcaggcagcggatgatgttatgcttgacgccgcaatccacaagaagcactttcttcttaccagttccttcgttgtaacggataatctccttgcagctgactttatccacataattcacatcggcataagaagcctcaggcatttcatccgattcatcatcaaaggcgatacgtcccatcatcaccccatgctcgcgaagcacctttgtcagttcgcgggtatcgatgcccgtgatgcccggaatctgttcgcgtttcagccagtcgccaaggctttctatggcattccaatggctataattttcgctataatcgcttacaataatggcttcggcatggatatgctcgctctccataaaagtggcaagcccattcggttcgagagtaaaaggcggcacaccgtaattgcccaccaacggataggtgagcgtcatcagctgtccggcatacgaagggtcggtcaggctttcgggataacccgtcatggctgtattgaagaccacctctcccgctaccggtttttcaaagccgaacgacttgccgtggaagcggctcccgtcgtcgaggattagagttacatttctcattgattcaattaaaattgataaacttgttctatataatcaataaatgccttgttcagcatcttcacaccgcccggcgtaggataatcgccgctgaagtaccagtcacccggatgcttggggcaggcctcatgcagcccctcgagaggctggtagacaatctgcactttggctttcgtccctttgggagtgagcagttccaccatcttggcagagatttcctcgtcggtaaagggagcgtatatctccttcacgtaattcaccatctgctctttgggcaggcctacctgctctttggacttgcggtaggcggcggcaatcacatcgcgcatctcacgctccttcagcagttccacagcagccttgaaggcgatgaattcgctcatcttagccatatcgatgccatagtagtcgggatagcgcacctgcggtgaagagcttacaatgactatcttcttcggccccagacggtcgaggatgccgatgatactctgcttcagggtggttccgcgcactatcgagtcgtcgatgatgaccagattatccactcccgggacaaggcttccgtaagtgatgtcgtacacatgggcggcgaggtcattccggctgtttccttcggcaatgaaggtacgcagcttgatgtccttgatggccactttctcgctccgtatgcgccgcgacaagatatgctccagctcgtcgtggctgggactatgccccagggcggcaatctgctgtaccttctcctcgttgaggtagtcgtccaatccttgcagcattccgtaaaaagcaacttccgccgtattggggatgaaggaaaagacggtatggtccacatcgttgtcgatggctttcaatatgttgggcacgagtttctcacccagcagtttacgttcccggtaaatgtccacatcactgccccggctaaaatagatgcgctcgaaggaacaaggcttcacctcgcgcggcttgttgatttgcacggtgcgcaccttgccggccttgttgataaacatggcttgtccgggttgcagctccctgatggagccggcagggacattaagggctgtctgtatcacgggacgttcactggcaagcaccgctatttcgtcgtcctgataccagaaggctgtacggatgccccacgggtcgcgtacggcaaaagtctctccgctgccggtgagaccgcacatcacgtatcccccgtcccactccttgctcgaggtgcgcagcacgttggcaaggtcgatgtggtcttctatataatgggtgatgtccatgcctgccagcccttccgcttcggcaaggttgaagaggcgctccacttcgcggtcgaggcgatgccccaactgctccagcatgatgtaggtatcggcatatttgcgcggatgctggccgatggcggtaatgcgtgcgaagatttcatccacattcgtcatgttgaaattgccgcagagggcaagattcttggcacgccagttgtttctccggaggaacgggtgcacgtacgagatgccggacttgccggtagtggagtaacgcaggtgccccatataaacctccccggcaaaaggcagtacacgcttggcatatcccgcatcgtgcagctgttcctttgccacgtccttgaagttgctctgcaccgtaccgaaaatttcggtaatggcacccggaccgagcgcacgctcacggaacatatattcctcgccgggattggcttccagtttcacgcaggccagcccggcaccctcctgcccgcgattgtgttgtttctccatcaggagatagagtttgttgagcccgtacatccatgtaccatacttctcttcatagtactccaatggtttcagcaggcgtatcatggcaacgccacattcatgcttcagttgttccatctatctatttatttactatttgacgatttactattgacgatttgatagatatgcttttgctattggacgattgacaatttacgatttgataaagtatttaccattaaatagtaaatagtaaattgtacatgtcctcattctacagtcaccgacttcgcaagattcctcggctggtccacatccattcctttgcacacggcaatgtgataggcaagtaattgcagaggtaccgtagttattaacggatcaaggcactccattgtttcgggaagctcgatgcaagtgtcggctattttactgatgaccgtatctccctttgtcacaatggcgataacccttcctttacgcgcctttatttcctgaatattgctcagcaccttttcataaagcccattctgggtggcaatgaccaccaccggcatctcggcatctaccaaggcaatgggaccatgcttcatttcggcggcaggatagccctcggcatggatatacgaaatctccttcaacttcaaagcaccttccaaggccacgggataactgtatccgcgtcccagatagataaagttgtgtgcataggtgaatatcttggaaagttccgctatgcggtcgttcagtttcaagacctccttcatcttgtcggggatatgtcccaattccttgacaactgccaggtacaacccttcgtccatcgtctttttctctttggcaagtgtcagagccagcatggtaagcaccgttacctgcccggtgaaggctttggtagatgctacaccaatttccggtcccacgtggatataggaacccgtatgcgtggcacggggaatgctggaaccgatggcattgcagatgccgtatataaatgccccacggcttttggcaagctccacggcagccagcgtatcggccgtttctccgctttgcgagatggcaatcactacatcgttgctgtcaatcaccgggtcgcggtaacggaactcactggcatactccacttctaccggaatacggcagaagctttcaatcaaatgcttgccgatgagggcggcgtgccatgacgtaccgcatgccacgatgacgaggcgtttggccgccagcagacgttccttataatcaatcacagcagaaagaaccacgttcgtaccctccacattgatacgtccgcgcatgcagtcgtgaatgcagccgggctgttcgaagatttccttcagcatgaagtgcggataaccgcccttctccagctggccgagattgagcgctaccgtctttacctcgtgcggacattccacattcttcaggttaacaaccttcagcttctctccccgacggatgagggcaatctcttcgtcttccagatacaccaccttatccgtatattccacaatcggcgtggcatccgaagccaggaaaaactctccttcaccgatgcccaccaccagcggactgctcttgcgtgcagcgattatcccatccggattgtccttgtcgagcaccgcaatggcatacgccccaatcacttcctgcaaggcaagttgcaccgccgtcagcaggtcaatatggtttgtcacctgaatgtattcaatgagctgtaccagcacctcggtatcagtgctgcttttaaatacataacctttggcttgaagtttttctttaaggatggcgtagttttcaatgatgccgttatggatgagggcgaggcgttcggaagaggaataatggggatgggcattgacggaacaaggttctccatgagtggcccaacgtgtatgtgcaataccaatgctaccggaaatatctttttgagcaacgaaagtttcaagttccgaaaccttacctttcgctttgtacacgttcaactgtcggttatcactgattaatgctacccctgcactatcatatccacggtactccaaccgcttcagacctttgataagaatggggtaggctttcctttgacctatatagcctactattccacacataatgtatcagtatttgattttgcgctgcaaatatacatattcttaagaacataaagttaatctttccactatttatttatcaaaagaatagaaaaaagttgtttttacatcaaaaagttaaagaaaatattattttaaaagcaaaaggcctaatttacaaatcaaaaccaaaccgtctgattttgatttaggattaaaagaaaacagagggtattttctatcaattcataacatcatctcctatcgtaggaattttgcaagaaagaaggcagggatatacactatcattttgcaattaatattatatatttaccaaacattttgacaccacaaataatattatatagcaataaagaaagcttataatcatgaaacaagaactttttaacaacaagacaaaagtagaggattaccagcgacagcccaaacagttgggcttgtataaggcatcccacgagcacgatgcctgcggagtaggcatgctggtcaatatccagggagggaaatcacatgaactggtagaatcggcattgaaggtactggaaaacatgcgccaccgtggagcggaaggggcggacaacaaaaccggagacggcgccggcatcatgctgcagataccgcacgaattcattctgctgcaaggcattcccgttcccgagaaaggaaaatacggcaccggcctgcttttccttcccaaagacggaaaagaccaggctgtcatcttgagcgtcattatcgaagagattgaaaaggagggattgaccctgatgcatctgcgcaacgtgcccacttgccccgaaatattgggagaagcggctcttgccaacgaaccggacatcaagcaaattttcatcaccggatttacggaaagcgaaaccgccgaccgcaaactctatataataaggaaaaggatagagaacagaatacgcaagtcggacatccccacccgcgaggatttctacatcgtctcgctctctacgaagaacatcgtctacaagggcatgctctcttccttgcagttgcgcaactacttccccgacctcaccaacagctacttcaccagcgggctggcattggtgcactcccgtttcagcaccaacactttccccacctggggactggcacagcctttccgcctgctggcacacaacggcgaaatcaataccatccgcggcaaccgcggctggatggaagcccgtgagagtgtactctcctctcccaccctgggagacatccgggagatacgccccatcgtgcaaccgggcatgagcgacagtgcctcactggacaatgtgctcgagtttctcatcatgtcgggcctgagcctgccgcacgccatggccatgctcgtaccggaatccttcaacgaaaagaatcccatcagcgaagatttgaaagctttctatgaataccactccatcctgatggagccgtgggacggaccggcggcactgcttttcagcgacgggcgctatgcaggcggcatgctcgacaggaacggactgcgccctgcacgctacctgattacgcagggcggcatgatggtagtggccagcgaagtcggcgtgatggatttcgagccgggagacatcaaggaaaaaggacgcctgcaaccgggcaagatactgcttatagacaccgagaaaggcgaaatatattatgacggcgaactgaagaaacaacttgccgaagccaaaccataccgcacttggctggccggcaaccgcatcgagctggacgaactgaaaagcggtcgcaaagtctcccatagcgtggagaactacgacagcatgctgcgcatcttcggctactccaaagaagacgtggaacggctgattgtcccgatgtgtaccaccggtgccgaacccatcaactccatgggcaatgacaccccgctggcagtactctcggacaagccgcaactactgtacaactatttccgccagcagtttgcccaagtcaccaaccctcctatcgacccgatacgcgaagaactggtaatgtcgctgaccgaatacatcggagccgtaggcatgaacatactgacacccagcgaaaaccattgcaagatggtgaggttgaaccatcccatcctgaacaacgcccaactggatattctctgcaacatccggtacaaaggcttcaagaccgtgaaactgcccctgctcttcgaagtggcaaaagggtgccagggattgcaggaagcattggcaaccctctgcaagcaggcggaagaatccgtcaacgaaggagtgaactacatcgtgctttccgaccgcgacgtagacgccgcccatgccgccattccgtcactgcttgccgtgtcggcggtacaccaccatcttatctccgtgggcaaacgggtgcagacggcactgattgtagaaagcggcgaaatccgcgaagtgatgcacgccgcactgctgctgggcttcggagccagcgcactgaatccgtatatggcttttgccgtcatcgacaaactggtgaacgaaaaggaaatacagctcgactacgccactgccgaaaagaaatatatcaagtccgtctgcaaaggcttgttcaagattatgagcaagatgggcatcagcaccatccgttcttaccggggcgcgaaaattttcgaggccgtaggactgagcgaggagttgagcaatgcctactttggcggactgagttcacgcatcggaggcatacgcctggatgaagtggcacgcgacgccatcgccttccacaaggaagggatggaggttcttaaaaagaagggggaagcggagctattgccgaaccgcggactgtatgccttccgcaaggatggtgagaagcacgcctggaacccggaaaccatcagcacactgcaacttgccacacgcctgggaagctataagaaattcaaggagttcactgccatggtagacagcaaggaatctcccatcttcctgcgcgatttcctcgacttccaccgcgctcctatcagcatagaccgggtggaaccggtagagaacatcgtacagcgctttgtcaccggcgccatgtcctacggttccatcagccgcgaggcccacgaagccatggctattgccatgaacaagctgcatggccggagcaatacgggcgaaggaggcgaagaccgggcacgcttcatgccgcgcgaagacggcaccagtctgcgcagcgccatcaagcaggtggcctcaggacgtttcggtgtcaccgcagaatatctggtgaatgcggacgaaatacagataaagattgcccaaggcgccaagccaggcgaaggtgggcagctgccgggcttcaaagtagatgaagtgattgccaagacacgccactccattccgggcatctctctgatttcccccccgccccaccacgacatttactccatcgaagacctggcacagctcatcttcgacctgaagaacgtgaacccacgggcaaaaatcagcgtgaagctggtggcagaaagcggtgtgggcaccattgccgccggtgtggcaaaggcaaaggccgatttgatagtcatctcgggtgcagaaggcggtacgggagcttctcctgcatcatccatccgctatgcaggtatctcgcccgaactcggtttgagcgaaacgcagcagacactggtgctgaacggcctgcgcgggcaagtgatgttgcaagtggacggacaactcaaaacaggccgcgacatcatactgatggcaatgctcggagccgaggaattcggtttcgccaccagcgccctgattgtactgggttgcgtaatgatgcgcaaatgccaccagaacacctgccccgtaggggtggcgacacagaacaaagaactgcgcaagcgcttccgcggacgcagcgagtatctggtgaacttcttcacgttcctggcgcaggaagtacgcgaatacctggcggaaatcggtgtggaacgcctggacgacatcattggacgcacagaccttatcgtccgcaagccggatgatggaatcaggaaacatcagttgataagctttgacaaactactggcacgcgtggataatgaagccgctatccgccacgtcaccgaccagcagcacggcatcgaccatgtgaaagatgtggagatactgcatgccgccgcccaagccgtagagagccgaaaggaagtctcgctggaatacaccatcgccaataccgaccgtgcctgcggcgccatgctctccggtgtcattgccgcaaagtacggagaaaaagggctgcccgaacatacgctgaacgtgaagttcaaaggctccgccgggcagagtttcggggcattccttgtcccgggtgtcaacttcaagctggaaggcgaggccaacgattatctgggcaaaggtctgagtggcggacgtatcgccgtcctgcctccggtacggagcaacttcgaggcagagaaaaacacgattgcaggcaacaccctgctttacggcgccacaagcggtgaagtttacatcaacggccgtgcaggcgagcgctttgccgtccgcaactccggtgccacagccgtagtggagggtgtaggcgaccactgctgcgagtatatgaccggcgggcgcgtggtagtactcggacagacgggacgcaactttgccgcaggcatgtccggcggtgtggcctacgtatggaaccgggacggcaacttcgactatttctgcaacatggaaatggtagaactgagcctcatcgaagaggcctcctaccgcaaggaactgcacgagctcatccgccagcactacctgtacaccggttccaaactggcacgcaccatgctcgatgactggccacgctatgccgaccagttcatccaggtagtccctatcgaatacaaaaaagtgctgcaagaggagcagatgcagaaattgcaacagaagattgcagaaatgcaacgcgattattgaatcgcgaattaataatgaaagaatgaaagactgaggaaattcccctttcattctttaattctttaactttttaatttgttcatcatgggagatccaaaagcattcctcaatatcccccgccaagaggcgggttaccgtccgatacacgaacgtatcacagacttcagccaagtggaacagacactgaacagccacgaccgcaagctccaggcctcgcgctgtatggactgcggcgtacccttctgccactgggcatgtccgctgggcaataaagacccggaattccaagacgcgctctaccggggcaaatggcgcgaagcctatcaaatactgaacagtacgaatgattttccggaatttacgggacgcatctgccctgccctttgcgagaagtcgtgcgtactgaaactctcgtgcaacgaaccggtcactatccgcgagaacgaagccgccattgccgaggctgcttttcgcgagggctacatcacccccctccagcccgaacgcaacggaaagagagtagccgtcatcggcgccggccctgccggattgagcgttgccgtacggctgaacgccaaaggttacgaagttaccctattcgacagcaaaccgatgccgggaggactgttgcgttacggcatccccaacttcaaactggacaaagccgtcatcgaccgccgcatgaaaatcctcaaggccgaaggaatcttgttcaagatgggagtccatgtcgatgtgcagaaactgcccgtcggattcgatgcctacgccatttgtaccggtacgcccaccgcccgcgacctctccattccgggcagggagctgaaaggcatctactttgccctcgacatgctggcacagcagaaccatattctggatggagataccttcccgaaagaccagctcgtcaacgcccgcggcaaacgggtactcgtcatcggcggcggcgataccgggtccgactgtataggcaccagcattcgccagggagccgtcagcgtaacccagattgaaattatgccccaaccgcccataggacacaacccggatactccctggccgcaatggcccgtcgtactgaaaaccaccagcagccacgaagaaggctgtacccgtcgatggtccctcgcctctacccggttcatcgggaagaatggcaaggtatgcggtgtggaagtggaagaagtggagtggcttccggcaacagacggtaaccgccctaccatgaaatctacgggtaagaaagaggtcatcgaagccgatatggtgcttcttgccatgggtttcctcaagcccgagcaaccgaagtttgcagagaacgtattcgtggcaggcgatgccgcccacggcgccagcctcgtggtacgtgccttggccgacggacgacgagtggcaacagaaatagatcgttacctcgaacctctaaaagaaaacaagaaatgatttccctttctttaatttttaacctttaatttttaattctcatgtgtggaatagcaggaatcttcaacatacagtctcaaactcctgaattgagaaacaaagcgctacggatggcgcagaaaatccgtcatcgcggaccggactggagtggtatctacgtaggcggctccgccatcctcgcccacgaacgcctctccattgtcgacccggaatccggcggacaacccttatattcacccgaccacaagcaggtgcttgccgtcaatggcgagatttacaaccatcgcgacatccgtgcccgctatgccggaaaatacgccttccagacaggttccgactgcgaagtcatccttgccctttacaaagacaaaggcatccgcttcctcgaagagctgaacggcatcttcgccttcgccctctatgatgaagaaacggacgattacctcatcgctcgcgaccccatcggcgtaatccccctttatataggacgcgacaaggatggacacatctacttcggcagtgagctgaaagcccttgagggtttctgcgacgagtatgagcctttccttcccggccactactaccgtgggcgcgagggcaagatgcaccgctggtacacccgcgactggatggactatgccgctgtgaaggacaactacactcctgccgccgaacgcaatgccgcgccggcttcgataggccggacagcctacagcacacaagtcacggctgtgcacgacgcccttgaagccgccgtacagcgccagttgatgtccgacgtcccctacggtgtcctgctcagtggcggactcgattcttccgtcatctctgccatcgccaagaaatatgccgccaaacgcatcgagacagacaacaaggcagatgcctggtggccgcagctccattccttcgccgtcggcttgaagggtgctcccgacttgattaaagcccgcgaagtggcccgtcatatcggtaccgtgcatcacgagataaactataccgttcaggaaggcctcgatgctgtccgcgacgtcatctatttcattgagacttacgacataaccactgtccgcgcctccacccccatgtatctgctggcacgtgtcatcaaaagcatgggcatcaagatggtactcagcggcgaaggtgcggacgaggtgttcggcggttacctttacttccacaaggcgcccacaccgcaagcctttcacgaagaaaccgtgcgcaagctctccaaactgcatctgtacgactgcctccgtgccaacaaaagccttgcagcctggggagtggaaggacgtgtccccttcctcgacaaagaattcctggatgttgccatgcgcatcaatccggcagtcaagatgtgccccggcaaggagatagaaaagaaagtagtccgcgaagcctttgccgacatgctcccacagaacgttgcctggcggcagaaagaacagttctccgacggtgtgggctacagttggattgatacgctgaaagccgtcactgccgctgccgtcagcgacgaacagatggcacatgccgccgaacgcttcccagtacataccccgcaaaacaaggaagagtactattatcgcaccatcttcgaagagcatttccccagtgaaagcgcggcccgaagcgttcccagcgtgcccagtgtggcatgctccaccgccgaagcgctggcatgggacgtctctttccaaggaaagaacgaccccagcggacgggctgtagcgggggtacacgaagaagcatacaaggattaaaaaaagagctgccgacagatttcctgccagcagctcttctcattttttatttatcaaatcctatcggactaaaacatcattgtctgtccaccaatcacacctgccacagcactcgctacggcaataataagtttcaaaatcacattccacgttttcttcataaagattatccattatctgattaataattcatagctactgttatcccagtggattctcaccttggtctccatccgaatccgagcctcctccttccgaaccggagccgccatctgtagaagtcttccccttaagataatcatccaaactcaccaaatccagcctctctccagcgcgggtagcagccttcgatatcttcagttccctattcgcctgaaaacagatacggacgctctccacactcttggctgtcacgtcatcagccttttcctcacctttcgatttggctgccagtataaaaacacccagcccggctatattaaccgtctttccttccagcaactgctctttcagcttttccacaaagttctgcatcgtactcttgatgtcaccgatagacagagaagagcggtcctgcatcttctgtgcaataaacgccaaatccacgctttgccccaatgttaccaactgcggataatacttcttgggagagttttcaaccctggggtccgacggtctctccaccgtcctgaaaattacactcatacttttttttctttagagatttaaattcgttttcctattcacacgtttcgttgatcaacgatgcaaaggtgaggattaaaaactatgtagccaaagaaaaaaggtgcttgggagtagtttttctgagaaaagtgataaagtgctataaatcaacaaaaaatatttctacaatatacaattcttcatttcatctactatgtatctcacatcctcatccatcacataaggaccgctcggcaagcaaagaccacgcttgaacaagccctcactgacaccattcacataggcaggattagccgcataaaccggctggagatgcatgggcttccataagggacggctctcgataccggctttatccaaacaaacacgcatggcctccacattacggttaggctcacaagaagtatgggcattcactgactcatgagtaacacccgcagcaccaccaacggcacctttcactgtctcacggtaggcatcctcctcacctctcacatgcagattcccgtcaagcagtaccgtgttcagccaatagttgctgtcataacgtccggaaggattctcatgaagcgtgattccctccacatcggccaacagctcacgatacagaccgcacagatgcttatggtgtgctatgtgctcatccaccaccgtcatctggccgcgaccgatacccgcacaaatgttactcatgcgatagttatagcctatcttctcatgctgataataaggataagcctcacgtgcctgtgtggcatagaacataacctccttctttgcctccgcatccggacaaatcaaggcaccgccaccgctggtggttatcatcttgttgccattgaaagacagcacaccatatttgccaaacgtaccacaaacccgtcctttgtacctactgccgaaaccttccgcagcatcctcaatcaccggaatgccatacttctccgccacagccattatttcatccaacttggctggcataccatatagataaaccgggacaatagcctttggtttcttaccagttttagcgatgcggtctttgattgccgcttccagcagctgcggatccatattccaggtatccccttctgagtccacaaacacaggagtagcacccagataagtcataggatggctcgatgcgcaaaacgtaaaactctgcaccatcacttcatcaccctgtcccactccacaagccaccaaagccaagtgtacagcagccgtaccggcagacaaagccaccacatgcttattctcacctacaaaagcctccaaatcctgttcaaagccgcttacgttcggaccgagtggaaccacccagttcgtatcgaaagcttcttgtatgaagcccatctccttgccgctcatgtgagcgaggcaaagataaattctcttatccataaaatatatgtgattattctaatgattcgatttcctcacgtagtggggaataaaaaggaaagaaaggattttataaatctttcccaagcactgtgtaaatgatgattttgatgtcattccaaaaagaccaactatccaaatattcaatatttatccgcactttgtccggaaacaaaaactcatcattatatttttgaggttccttctgttctgccaataattcttcctcgttccgatactttaaacttgcggggccggtaatgccgggttttaagagaagtattctccgatgctccccctcaagcctatcagcataaccgggaacatcgggacgagggccaacgaaactcatgtcaccaatcaacacattccataactccggcaattcatccaatttatatttccggagtactgctcctaacggagtgatacgactctctccttttacagaaatggaacttccagaatgggcgacagtcattgaacggaacttatacatcgtaaacaaccgcccatattgtccaactcttttctgtttaaatatgacaggacctccgggcatcttgatacgaatcaaaatgctgattataattaaaaccgggaataaaaagattaaaccgaagagtgatgcaccacggtcaaagagagatttgataaacattcaatcttgtaaaattatcttaaaaacttataagcaaattgagttacatgagggataggaataataaatataacaaaacgagcacaagcaaatatataattcacatatgataagttcagttttctaataacaagacatctatttttcaaatcagatagactttttgataaaccatttcttcttaaataaaaatccttatttacacgtacccgtaccaacacttcatctatattggcaaacttacatcctgataaaaaaccatttagccaaaatattgtatcttcatctttatccgtatcaacgggatataaacctgctttatgaaaataagattttctaaaaataacactcatatgtgccaatgggtttcttttcccaaagaaacatttcatttcatcatgtgatagaggatatcttataacccctatagattttttgttttcatccatttcttcaatatgtcctccacatatatctatatttttatgattgttcatatagattatttgtttttcaaatctatttgaaagacaaatatcatcagcatccatacggagaacgtaatcataccctttagatagtacaatagttaacaactcattcaatgaatatgccaacccataattttcatctctaccataaacatgaaaccgactatcatttaactccatgaagaagtgttctataccactttcaacaactccatcatattgaacataaacatgaaaatccttaaatgtttgttttagcaaactgtcaacacattgtgctacatatatcaatttatcatttttataaatcgacattattactgctaccattatttataatataacgagttaataccttacatgaattttgcatcggaatatctccccaaaatattttttttattctgttttgttcagtagtcaaactattaccataattccaatcagataatatttccattaatgaatcaaaactataggctcgaacacctggagtataatcatcaaaatcaaaagccaaatccctacattgacaaatatatttttcataatcaaaagggaataaaacaatacctttatccaataacaaataatcgtaaaaaatagaagaatagtctgttattagtaaatccgtaaatggtaatattggataaacatctacatccttatctaagaaacgaatgttagaaaatatacttgaaacattagatactacagtggcaggatgtaacttaaataaaaaaagttcatcacgtttctccaaaaaatcattcaataaatccaaattaatacctgaggctaacataaaatcagattggtcatctctgaaagttggcatataaataatagtatgggaaaattcttgtatatcctttatcagcctattaactccttgcggttcatattcttctacatatttctttattaaatttgcatttaaaaagaataactcacatctaggatatcccaaattaagacatttacgtatatctatttgaaagcatttagaaaaatgcattgacataaacactgaagtagaaaggaataaatcaggcttacgaaataaataaggaaataaaatacgattaaatatattttttacatatatcttagaatcaatgccaacagttgttgcaaactcaattttttttattccaacaccgtgccatagatttacagcaaagcatcctcccgaagtccaataattaatatctgataaatgagaagaaaaaatataatagtaggatgtcaaacaatgatatagcccatataaactccatctataatatgcattaatacctttttctcttaataacaatatttccgatttattagaagatatccaaataggaattactgttttctcatatttatataaatatctatataaatatttcacattgtccgtaaaacccactttatatcccaaaacccattttctcttacttcttggaattaagtatgaaagtaacaataatggatatcctagaaataaggaaattaaacgatatattatatcagtataatttctattactaaatacccattttataaaatgaagattattcatagtcagtctgttttacgtctgacatctataacttgtcccgtcaatccagaaagtaatgtcattattgaagtttctgcaacaaattggggacttaataaactattttccggttctataccaaagttttggatacgcataggtgttttagttctttccggattaatacaattaatctttatattataacttttccattcttcagataaagcctgaactaaattcacaattgcagcttttgaagatgaatataggctatacatcgctctgcctcgtgtatatgaactggaagtaaatagtaataaacctccatgagacttcgctaaatatgagaatgattccttcgctacatttatcgctcccaaataatttacacgtattaaatttaaaatatcatcatatttcattgtcatcaaaggaattttcaataatatacctgctgtatttataacgaaatcaatctttttctcaatcagatatactttttccaaagcttcttttactaatgatgcatcagcaacatctgttccagtctcacttcgactaaacgaataaaccttagctttcaatccggtacacagttctgcaatactatgtcctataccataacttcccccaaaaatgactataactttatgctctaatgcggtttcttgtccatataaagaaacatcacttacagattttaattgaaaaagcttatccaacaaaaacaaatcttctttatgcgttaacttcatattaaatttctctcccggtacaactcctattggtatatcaggcatatattttaaaacaaccccacaatcatcggttgttttaaaattaggatctaccaatgcacgtttatatgcttccctaataacggataatttaaatgcttgtggggtctgtccattgtataaaaattgtcggttaggaatatcctctatttcatgcgtattcagattcattttgataatggtatctgttgcaggaattgcaacatcaacagctccatacttacccaacatagtaatacaatctgatattattcttttagtaactaagggacgtacactatcatgaaatattaaattaatatcattctctgtagaagcataggcatttatagctgacaaacttgaataataacgttcacttcctccttgtagaattcgtcctactttcttaaaattattaatgcaacacaattcctccactttttcaagataattagggtgtaccacaattgcaatttcatcaataagcggatggttatcaaatacagaaatggtatgttctaaaactgtttttcccgaaactttaaaaaattgtttaggcattgtccctcccatacgagttccgacaccacctgctaaaattacagcaacatttctcatgctaatttctttattctaactaataatccaattaaaaaatagtaaacataaaacattcttacctgtaaccaagacaaaatcctcctcttaaaccctattacatggcaagtactacaatataataaaactgatttgtacctggagtcttgagttataattcgagttattgaaatagctttcttattgaatatggctattcgaggatatttataactcactgcattagaaacccaatcataaataatccaataaaaaacatctttaataactggatatttatatttttcatatatcacaaataattcattaacagtaaacaaaatatccaaatccttttcttttatagtattaataatactatcgttacgtcctatataataattatataacaattcatttaacacataaactcgtgccccttgtatcatacattggaaattgaacaacaaatcttcataaacaattcccgatttaaagttcaaccctctttgtcgtaaaaatgataatttatataatctgttacaggctgatgcgctaaagcgattattcagcttagcctggaccaaatattccttaccatctaacagattatttccccaatacgcaggatctctaactttttctatgcaatcctttatcaaatatcgaccaaaaaccactatatcaacctcaaatctctctattacttgcgataactcataacatgtattaggctctatagaatcatcactatctaaaaataaaacatattctcctgatgctatatttaatcctgtattacgagcttcacttaaacctttatttttctgatatatatatttaattctttcatcaaataaataactttttatgatattatcactattatccgtcgaaccatcgtttaccaatataatttcaatgtcctgaaaagactgtttcatgacactatctaaacatctgttcaaatatttttcaacattatatataggaatgataattgaaataagcataaaactaaatgaattttattttaagtttcggaacatatagaattaaactataaaaaaataagaatatcaaaatatttatcaatgaagggaaaaatgaagcacgaggcatatacactatattaggaactaatataaaagccaaaaacatgataacacgagtattacgaacacttttctcaaaataacgaataatatatccagctaaaaaactcattagtagaaatccgattaatcccaaatcccaaaactctccgagaaaactagaaccaactccctctccccccaagtatgcatccggtgctaaaaaataagtcaatcgatgtcctaaactattagtttgctccacaaattccatagattgaccttcaaaagttgatgttaaggataaaggatacaaaatatatggtaatccagtatttacaaatgttgatttataaaatatcatatatgcaaatactaataacgaaaccccttgttgagaaaaaaacatcataaataaatcagaatcataaccagtatcaacgtcccccctccggaactccaataatacttgtgacagaataatacacacgattgaaatcaataataatttgcctattttttgtttttgttgttcagaataaaatgaataataataccataataaaaatataataggtaaaaatagtttagaacgtccaccctttaaaacatctgcaattcttaaagcaaagaaaattgacgatatgataaagaacttctttttagaaggtttcgatgctaaaaataagcaatatgaaaattcaaaaatagatattgctcccgtcgtccatattggatatttcaaatttgcaatagttccatcatatacagctaaatatccatgctccaacacagctttaaactgaatcaaatatttaataaaagtacctggaacggagaatagaaataagaaagtagatattttatctagatacctcgaatattcaaaatttatctttctataagacaaatattttctacccatcaagcatccaagatgcataaatagcaatgaaaatgttaacaatattaatatttgaaactgtacgtttatagggaaaatgaaatcattatatttatctgcccatgtccaattaaacaaaccataaatatccaagaatatacgcgaataaataaacacacatagcatatatagaaaaagaacatacaaattgaatgttccactttcatgtatcgcagaaaaaagtgaccacaaaaaaatgagtaacaattcatattgtagtatattaattgttacatcattatatccaaatccaatacaaaataaaaattggagaaaatagcaaataataataaaaatctgtattacttgaaaaatggaatatttccacgtaaaacttatcatctaaataaagtattaactttacatatttgctgattcaaatcaaaatcagataatctatgccttaatttagtggatatcaacaaagaatgttctgacgctttacaaattgcttccgaaaaagaatttatatccaatgaagccacatatccaaactctccattacacaatacttcttcagcacctacacaaggagaggaaacaatatttctttctaaaattaaagcttctattattacagtcggtaatccttcatatagggaagataaaacaaatacgtcacaggattttattaaaggatatggattttctttaaaccctaaaaaatgtacataatcttgcaatcccatatcatctctcagtttttccaactcaacttgtaaaggccccacacctaaaatccataatgtaaaatttcccttgttcaacaataaaggcatacactcaatcaaaaatcgatgatttttacctttgtcaatcctacctacagccaataaatttattctatcccgactaaatggtacattaatatgtacatttgatttttgtataatatcagaaatatcaataggattatataaaacaatcgatttatttttgacagcagggcataaatttatcaatgtcttttgacaagctttagaaacacatactatttgatttaaagaaggaaggtcacgaaaatatctccgcttattagttgttttacagtaggtatgctttattaaatctgtatgtagccaagccactctttgcgcagtagcaggagctttaaataaaattctggtagcagtatcctctctaaaagcaatataacaatcgtatagtttccttatatgaaagatatagaacaagctaggaaacgttagtaaaatacgtctcttaattttatttattagcagatttgaatcccccaaagcagaatataaacatatattccgaggaacactatcaagataaacaccctctctatttattaaaaaaagatctacattatatttttttgcatcaagatgttgaagtattgttatcaatatcctttctgctccaccacctttcaaattatctataatgaataaaagattttttttcatgacctacttttatctttaatatataataaaattcctaagaaacaggctattataaaagtccatcttctatttatagcttctttatatatattcctaaaactttttcctgcaaatagactataacgcacataacttgcagcattaataacatagttagtaaatgataaattaaaataattcctctcatttatatacagagcataaccattaggatttcttaaacacagatgtctgtatttgctagacagaccatctctttgataatcttttatttctaaacttcgcttaatacaacatattttatatcgcaaagaaattctatttaaaaccaatgcttctgttacaaagaattcattctcaaattcagggaatggatattctttcaaaatacgagtataataaattaaccctttatctccttttactgacaatgaattgtaaaggttataatgtgaaacaaccaactcgtctacaggtagcgaagttcctattagatttccatgtaaatctaaagaattacatgaaaatcctgctatccaaggattatccttatgtatcaaatgatatgaataaattatttctagtgcagtttcaatataataatcgtcagaatctaaacaaataaagatttcccctttagctatctgcactgctctattaaatgcacgatgctttcccccattctcctgcttcaaatatacaatggaaattttatttgtatttatccatttctgaactatttcttctgtattatctgtggaaccatcatccacaataatccattcaaaactacgtaatgtttgtttacacaaatattcataggtacgtcctatagtattcgctctattgtaagtcggagtaaatacactaaagagaaattccatatttttccattaaacaattaacatctgaaaaaagtaaactattacttcttatccattcctcatccatattccaccactttaattttaacaaaaaatctatttgattctgctcaaagcgcattctaatacatttagccggtactccaccataaattgaataaggcggtatatctttagttacaatagaatttgctcctattactgcaccatcaccaattgtaactccatttacaatagtcacattagcaccaatccatacatcatttccaatagtaactatagcaaactggtcatacctatcttctaaaaggaactttccttttaaaaataacctcggagaagtcgtaacgttcttttctactggatgattacccaagccagctacgacattaggacctattgaacaaaactttcctatatggcaacaatgtataatagagttataatttacatatgaataatctccaataatagaattactgaaaataacgcgagctgaaaaagaacaatcacagcctataacagtatttcctaataattgtacatctcgtcctatattgacagtccttctcctaaagagtctcataaaccgatttatgaaattcatcatattataccatattttttacaataataccatctctgtaaagtttcaaagaaaacagatattaccaatgatatagataaagtatatatatttaaacaatcaataattcccaaaaacattattacgaacaaatacacgaacatactataaaacatattgacaataacatcttttacatgattgtgacttattaatataacagttccaagaaaataacttaaatggcgatatataaacagagttcccaacatccaatacacaggaattgccattagcatatcattattaaaaaataaaagaataaatgatttcaaagaacatccaacaataaaatataataaaactcctattacagtagtatatattaaaagtttacgggcaaatattttattagcatttttattataatatggaaatacaacattacttattgtataaaatatagtagataatacatttactattttttctacaaaatcataataagcaacttctcccattcccaaaacgctaccaataactatagtattagtcctatctttcactatacctgttattgacgttaagagaagtttggttgaatcttttgtatgataaaatatagtcgctaaagactgccatctaaacttaattttaaatttatatattagtatatatatggctataagagatgtaataatagctccaatgccatttataagtggaaccaataaataatcttgcggtgtagtgacccatataaatatcaatagaataaacactacacgtcctatgaaagaaaaaattgcaatatatttcattttttctataccttgaaaaaaccatataggaaataaacattcataaatacattgccacattgaaaaaatatataataatttatattctcgaatttcaggaaaaagaaatattaaaaataagaatccaaatactataattaaaagcaaggtttttacaatatataccacactaactatttcgtttatcttctttgaatcttctctattaatgctaatatatttcgtagctgagatattaaatccccagtttacaaatattgctaaataactaactattgcctgagaatatatgattacaccatataaattttttcctaaagtattaattaaataaggatatgtaacaagtggtatcaataaattacatatctgtaataaagttagatagccaaaattttcaattaaggttttatacctatatatatagtcagatatatttttcactttgcaaattaacatcatcgtaagcactcaatcactttggactcttctgaaaataagtaagcagtcattttagacctgaaaaggtttaaaagtaagcactcaatacctttttccctactgaaaatcagcgagaaagggaattggtcttattatatttgacttcgatttaacttaattcaaaccgaaatgcctgatggaatcagcatttcgtagttcttgtttcctgacaatagttcacggaatacatgtataagatatcccttgatatccgagaggtacatcttggccgtttcgataatggtatagaaagtcattgccacattgacaccctcctcactgctgaagtgaagagaattatttcgcgatacggcaaagggacgtatcgcacgttccgccaccatgttgtctatcgtgtagtcgccccagtggcgatatttaagcaggtcatcccagccgttcaacatataagccaaagctgtctccatcattttaccgtagtgacagcgtttatcctgctgaagttccaatacctgtttcctcaagcctttcaatatctcactgacatcggatttatttcttcttttccttatctccccgagagtgagccgacgcatcaaacattcagcctctatcagatacaaccgcccaatttgttccacaaaccatgccgcctcttcgtctttggcgatgtctgcagcaagtttgaactttgcccggacatgagagatgaacttggaaactccctccttttgatagcgtttccataaattcttgaaatccgtgctgcttgccataagcattcgttttatctttatggcacaaaaatctagcatacggggcggtaaagcaaataaacaattgagtgcttaccgtccatatgggtaagcaataatacgttattttttgaatccggcaccaactctccctatccaaaaagcgatgcaacgccatccgcatccggatttcctttaccgaaggtatcagctggccggcatttatataattcataaactgagggacgaggtccgaaagggaatctcgtacagagtcaggcatcagcatgtgccattcacctttaacatcatcctcatatgtcagcacaagaccgaacttctagagtttatagggagttttgcgtattgcgtaccacgtatgcattggcaccgaccgtgacaaactcctcaagcaactgatgttccgccttgcaaagagaattgcagatggcagcaaggctgatattagaaccgtattccttatttttgatggtaaccatatttccaattttagaaaacaaaatcttccacaatatacctgtctacattacgcctttccttgctgaaattcacccccactttgacaagacgcctcccgtccaacctataaggaatcagataccctttttcatcaatctgccgtaaagcctcctcggcactgccgttcagtttaaactcaaaaacataaatggtatctttcgtcttcaccacggcatcggcacgaccgtgggcactacggatttccgtctcaacaaattgtcccatcaaagtgaaaaccacataaaagacagcctggtagtgacgttccgtattatcgctcaaatcgtatggcataccggcaaaaaacacccggagacgttccatgaaagcatccacatcaccggaacggagttcacgcataaacttggctatgtggaaaccggtttcatcatcggtcacttccgtataataaggtaccagaaaattcaagaaaccatagcgtacctcatcattgggaaaacccaaagtgtacaataaaacatccctgtcgtagtctttgatggtcagataaccactctggtaaatcatgggaagcgggttctttacttctgcacgatactcaaaaaaagcagaagccgtcacttcaactccctcaatcaaaaggcgcaaatcataatcactctttttcaacaagttagccaagtaggtaggagtaccggtctgaaaccagaaattatccaaaatcttcgacttgcatgcattcaacacactgaaaggattaaaaaccccttcacaatgagggtaaaaatgataaccgtcatacagcttcgtcatccgctccaaagttgtatcgaagtccatcccattggaaacacccaaacgttctatctccggagtaaacgttgtgagcagttcttccttagtaataccacataaagaagaatagtcgggccatgtactgatgtcctgcaactgatttaaatcactgaacacgctaatctgcgcaaacttcgtcacacccgtcaaaaaaacaaagcggagataacggtcggcacttttcagtaccccataaaaggctttcaatatccgacgatactcttccgttaacttttcatccgaaagagcttgaagcaaaggcttatcgtattcatcaatcaacactaccacttgcttacccgtctgggcatacgcctgctctatcacataggcaaaacgctcttcgggactacgctcctgcttttccgcaccatatttcaattcccacttttccagatattgattaagcatggctaccaaatctccggctgtttcatatttacgtgcattcaagtccagatgcaatacagggtattcctcccaccgggtttcctgtttttcgatggcaagcccgtgaaacaaatctttacgtccttgaaagtaagcttcgaaggtagatataagcaaactcttaccgaaacggcgaggacggctcaaaaaatagggagtggaattggatgctatcttatagaccattgctgttttgtctacataaagataattttcttcacgcagcttttcaaaagtctgtataccaattggcagtttacgcatctgttccatcttatttctcttttttagaagctatatgcaaatatacgttttttcttcaaagagaaatcctatttatacatttttattccatttcctcccatggataaggattatccaccacattctgaaactcgtcaactgcttcctgctgctcggcagtcagtgatgcaacactccaagaagcaatgatagaacggccttcgtcggccaaaggctcatcgaaaacctctccataacaagccgtaagcaagcggagtttcagcaaagaggaaggaagggaatcaagggtatcccagcaacgcctcaatacctcctgcacatgctgtagtttttcaccatggtcaatgaacgaggcactataccccttcaagagagcaagacagacatttgcctgctcctccaccgtggtgccccaggtgccggaattatacaaagttgtggtcaagcgatagacttcgctgttacgacgagacaaatcatcgctatagataggactaccgtccatacccaaatacatcagatcgtgcgcggcacgctgaaggaggagtgcttcttctaaaagagacatgagtagtaattataaattaaagactagcggattacttcaatgaggtctggatggatggtcgccatggcaacggcaatgataccttgtatagcaatcactacgcgacgatcacgggcaccttttacttttagaaaaacaccttcttgaccctcgaagtcgccaccggtgatacggactttcgtacctttggagagattcagttcttcgggttggaaatagagaagatggtcattgtaggtaccggcgacggctatgaaacgctgcatatcatggtcgggaatgactattttccgaccgctacgggtatcggtgatatattgcaaataagtaatttgagatttaaatcgctgtacttcggaaggacgtgcatggacaaaaaccaggttacggatgacgggaaccaaagcacggactttcctgcccctacggatacttatcttatattgcatgggaatgaaacagccaagatttgccttttcgagaagatgcatagcctcaagctccctgcggtatgtggcacgcatggcaaaccaaacttcggtctctttatccatttctattcttgctaattttacttagaaaaaggtattccttgggggctttgaactactattacagaactgtagttcaatcacttgcgagcattttatgggaagtttgacaagcactatgctcttcttgtcaacagattctctgcggttgttcattaccttttggtaagagactataaacgaacgtattagaaacaaaaaagcgttttttaatcgtacgtttaatgaacgcaaagatagagacgttttttgtaatggcaaaatgtttgatagaaaaatgttcctaataataaataatgataagtatattgcattgaatttcagtagtatatgcaatatatgtaatcagttaaaatcttcttatttttagctctttgagtatgtcttgtataagttcgaaataggtgttttttaaacgtacgtttttaaaacagcatatcatcttatatatcaaccatttacaactcacccttcacatttccctccaaaatccccttatttctccctcactttttatactttcgcattttttaaccagaataaaaaacagttaaacgaacgaagaattacacaaatgaaagaactcaaaaaaagaagcatctcaacagtaacgaacagagaagcatgtcgtatcaatctgatacacagaaaataaaagtaacaaaagtcaaagagcactgctccatagtgaacgaaaatctattgtcagaacgggtttactacggagaccagacccatgtttatgtaggttacttaagagcctttaaatcaggctattttgaaggaacaaatatcaagaaaattacagatatagccaaactattcgttgcttccgaaaacttcacaaagagaaccagaggagagcaaaagcctttgacttacagtacgataatcaccgaattggagaaggtatgggccatcataaaacaggaagacaccacactgattgacccatacggatatgatgtaaggataaatcactgatagttcagtacctggaaaggcagtaattttgccgccgtcagcaaccggacagaagggctacacctttcttgtcggatggtgtagcctcaacaaggcaagggcgtagccatccgtactgaaaggagtagccctttttcattgctgattatcatacatttactaaccctaaaaacataaaaaatgggaaaagaaaaaactgaatttgaggagaaatttgtatccaaaacagaaaaagcaaaaaagctatgggaaaaacggattacggaaaacacgacattgagcatggagtctgtacaatggatggcacaacgcataaattccctattggaatacatgcgatacggatatgcattgatagcctaccgaaagcaggacggcagcttctacatgggaagaggaacccttgtttcctacgaaagcgacttcaaaaagaaacatgacatgacaagcattaaagctcacgtagcctattgggacgcggaacaacaaggctggcggacttttctgattgagaactttatggaatggagaccgatagtaaactaacaaaaaaacaccaatatcaaaagctatggaggcttatttactacatgatgccaatgccggcagcaacctaaaattaatgattatgatacaagaagaaggtatgaaaggatatggcatttactggacagtgctcgaattcctcagattgcagaacgaatataaagccagcctgaaagtgattcccatactggcacaaaaagcaagggtgacaactgccacactgaagcgaatcatctatgactatgcgctgttcgaggtgaacgagacaagcttctcatcccccggactaagccgccgcatggagccatgggacgcccaacaagaagctaaaaaggaagccggacgtcgcggtggactggttaaccagcagagaatcagggatgccaagacaagcagcgctttagcaaataaactaaataaagagaataaagaaaacccctctctatctccccaaggggagacgggaagaaggaaggaggagattcttctgactccaccggagtacacgctcaacagacagacgcataattaccaaggcctaatggaagaactggcaaggcagaaagtaaccgacatacacgatttgaatgccatcctgagactgacggattttggaaaactgggagggaaaatctggaaaatcctatacgagttgaacagctcaccccaactgaaagcccgtatcgtgatgcctggaaagtacatactgaaattactcagaggttagatttaataaaagaaatataatacttatctttgtgtccataacaaaacaccctaatcattatgaatctgaaaaaactattttttgcttccgccctgctctttgctgcatgcggcactatccaggcccaggaagtcattgcccaccgtggtttctggactacggacggctcggcccagaactcccttgccgcacttgtaaaggctgattctatccactgctacggctccgagttcgacgtttggctcaccacagacaatcagctggttgtcaatcatgacgccacctttaaaggcgtgactatgcaagatgccacagccaaggtatgcaccgccgtacaactggacaacggcgaacaactccctaccctgcaacagtatctggacaaggcaaaaagcctgaaaacccgccttatcctcgaactgaaagcccacaagacccccgaacaggaaacacgagccgtagagggtatcgtaaaaatgataaaggacaaaggactggaggaccgtacggaatatatcaccttctcccaacatgccaccaaggagtttatccgtctggcacccaaaggcacccccgtctactacctgaccggtgaccttacccccaaggagttgaaagcatggggttgtgccggtcccgactatcacttcagtgtcttccaaaaacatcctgaatggataaaggaatgccacgacctcggcatgaaagtaaacgcctggaccgtaaacgaagccaaagacatggaatggctcatcagccaaggagtagatttcattacaaccaatgagccggtagtgctggaagaaattttaaagaaaaaatagccgctccttatacatttagaaacaaaaaccaaacaaaccgcttcattatgtccgcaatggagcggtttattgttttcaaaaagatagcaattagccctataaaaaatcttttttcttattttgaatcaaactaaactttcacatggattacaatttatataaaaacaaagccatatgcttttaaattgaaagcctgacagtagatattctcattgaatgaaagtttcgctaaaaataatagaaaatagatatgccttacagttaattataaaacaaaacgtcgtatatttgcatcgaaataaaacaaaaggatatattaaccaaccgataaaggacaaaatgacaagagctataaaattcaccaagatgcacggtgccggaaacgactacatttatgtagatacgacccaatatcctatcagccatccggaagaacttgcgagggcatggagtgcaccgcatacgggaattggaagtgacggtctggtacttatcggttcttcggacaaggccgatttcagcatgcggatattcaatgccgacggctcggaggcccggatgtgcggcaatgcaagccgctgcatcggaaaatatctttttgactacggactgacctccaaaacagaaatcgcactcgatacactgtcaggtataaggatgctaaacctgcacttggcagacggaaaggtcaactctgtaaccgtagacatgggcatacctgccgacgaaccggcagactacgacggcaaaggagccaaaccgatgaaagaacagcccatcgaagtggacggagaacgatatgtagggaccaccgtatccatgggaaacccgcatctggtaatctttgtcaatgatattgaagccatcgaccttacagtcatcggtcccaaactggagaatcaccctctcttccccggacgcatcaatgtagaatttgcccagatattgggagaaggaaaaataaggatgcgtgtctgggaacgaggctcgggcatcacccaagcctgcggaaccggagcttgtgccaccgccgtggcagccttcctcaccggacgcgcaggaagggaatccatcatcatcatggacggaggctcactcaccatccgatgggacatcgccaccaggcatgtactgatgacgggagaagccaccaaagtattcgacggcaaaattgaattaattgactaaccaccaactatcaaccaagaaaagattatggcattagtaaacgaacattttttaaagctaccgggcagttatctgttttcagacatagccaagaaggtaaatactttcaggataacacatcccaagcaagaggtcatccgtctgggtatcggagacgttacccggccactgccaccggtctgcatcgaagcgatgcacaaggcagtggaggagatggctgacgcacggacattccgtggatatggtcccgagcagggatacgacttcctgatagaagccatcctcaagcacgattaccttccgcgaggcatccatttcggtcctacggaagtcttcgtgaacgacggagcaaagagcgacacgggaaacatcggcgacattctccgccacgacaacagcgtgggagtgaccgaccctatttatccggtctatatagacagcaacgtgatgtgcggacgtgccggagtactggaggaaaacggccagtggagcaacgtcacctacatgccttgtaccgccgagaacgacttcatcccggagattccagacaagcgcatcgacatcgtctacctctgctaccccaacaaccccacgggcaccaccctgaccaagcccgagctgaagaaatgggtggactatgcgctcgccaacgacacgctgattctgttcgatgccgcctacgaagccttcatccgcgaagacgacgtgccccactccatctatgagataaagggagcgaagaaatgcgccatcgagttccgcagcttctcgaagactgccggattcacgggagtacgctgtggctacaccgttgtgccgaaagaactcactgccgccacgctggaaggcgaacgcatcccactgaacaagctctggaaccgccgccaatctaccaagttcaacggtaccagctacatcacccagcgggcggcagaagccatctacacaccggagggacagcggcagataaaggaaacgatagattattatatggacaatgcccggaccatgaagcagggccttgaagcggccgggctgaaagtctacggcggtgtgaacgctccttacatctggctgaaaacgcccgacggaacaagctcctggcggttcttcgaacaaatgctgtacgaagccaatgtagtgggcacaccgggtgtaggtttcggccccagcggtgaaggatatatccggctgacggccttcggcaagcacgaagactgcgtggaagccatgaagcgcatccggaagtggctgaaataaaaaaacaattgaattagcgaggtacttgctataatcgagtcggactgatcatccggaatttttctaaacttaaaggtaaaaaggtatgaaaacaaaaagtgtaaaatggggaataatggcaatggcgctgttatcaatggcaatgcctttcacggcaaaggctcaggataaagtggaagcgtcggcaggcgtcgacctcgtaagcggttacgtgtggcgtggccaggatttgggaggggtaagcctccagccgagcgcatccatcgcctacaaaggtttctctctgggagcttggggctccgtaggcatcgagagttcggacacgaaagagttcgacctcatactgggatattcaaccggaggcttcagcgtatcggtgacggactactggtacaatgtgaccggagatggggtgacagccaaatacttccagtacggtgcacacaatgctgccaactcacatctgttcgaagcgcaaatcggctatgatttcggccccgtagccgtaaactggtacaccaactttgcaggcgacgacggtgttgacaaagacggtgaccgtgcttattcatcctacatctccgtggcagctcccttcacactgggcggtctggactggacggccgagataggcgctaccccttgggccacggacttctatggagccaacggatttgccgtatgcgacgtcagcctgggagtatcaaaagacatcaaaatcaccgattccttctccctcccgttgtttgccaaagcaacctggaatccaaggtctgaaggtgcctatttcgtagtcggactaagtttctaagatgaaaaacctatgatttacacacaccgaaaggcaaatagtaaatcgtaaattgtctaatcgtaaattatttaaggtatgaaaaagattgaagctattatccgaaagaccaagttcgaggacgtgaaggacgcgctgctcgaagcggacatcgaatggttctcctattatgatgtacggggcatcgggaaatccagacaagcccgtatctaccgtggtgtcatgtacgacaccagttccatcgagcgcatccttatctccatcgtggtgcgcgacaagaatgcggaaaagaccgtacaagccatcatcaaatctgcacaaaccggtgaaatcggcgacggacgtatcttcgtcatccccattgaggatgccatacgcatacgtactgcagagagaggcgacatcgcactctacaatgccgaacaagaaagataacgggcagctacaaaccacaaccaagaaaatacaatacaactaaaagcaacaagaaattatggataaacttattttaagtgaactgaccaacggactgaacactgtatggatgctgcttgcagccatgctggtattcttcatgcagccgggctttgcactggtcgaagccggtttcaccagagtaaaaaatacggccaatatcctgatgaagaacttcgttgacttcatgtttggcagcctgctctactggttcatcggtttcggactgatgttcggtgcaggcggattcataggaatgccccatttcttcgacctctcgttctacgacggaggcgggcttcccacggaaggtttcctggtattccagactgtattctgcgcaacggctgccaccatcgtgtccggcgctatggcagaacgtaccaaattctccatgtacctggtttacaccatcttcatcagtgtgctgatttatcccgtttccggtcactggacttggggcggcggctggctgatgaacggtgaggcaggttccttcatgatggaaacattcggaacaactttccatgacttcgcaggttccaccatcgtccactccgtaggcggctggattgccctggtaggtgcggccatcctcggcccgcgcatcgggaaatacggcaaagacggcaagtcaagagccattccgggacataacctcacgattgcggcactgggtgtattcatcctttggttcggatggttcggcttcaaccccggttcacagttggcagcagccactacggacgatgcaagggccatctcgcatgtattcctcaccaccaatctggcagcctgcgcaggcggtttctttgcattggcggtaagctggatgaaatatggcaaaccctccttgtctctgacactgaatggcattctggccggattggtaggcatcacggccggttgtgacatggtttctcccttcggggcggtaatcatcggcaccatctgcggcatcctgatgatttattcggtggaattcatcgaccggacactgaaaattgacgaccccgtaggggccagttccgtacacggcgtctgcggtttcacgggaaccatcctcaccggactgttttccaccagtgagggactgttttacggtgcaggctggagctttctcggagcgcaggtattcggtgcactcgtagtaggcgcatgggcagcaggcatgggattcatcatcttcaaaggactcgacaaaatccacggcctccgcgtttccaaacgtgtggaggaagaaggactcgacatttacgaacacggcgagtctgcctacggtgcataatgattttatattttattaaaccaacaattacaactctaaggtattatgtcaaaattgagattcagagtagtagagacggcgttcaagaagaaacccgttgcagtggcagtcccggcggaacgtccgtcagagtattttgccaagtatgtattcaacaaggagaagatgttccgctatctgccgagcaaggtgtatgccaaactgacggatgtgattgacaacggagctccgctggaccgcagcatagccgacgaggttgccgcaggtatgaagaaatgggcggttgaaatgggggcgacccactatacgcactggtttcatccgctgaccgaaggtactgccgaaaagcacgatgcttttgtggaacacgacggcaaaggcggcgtgatggaggaattcaccggcaaactgctcgtgcagcaggaaccggacgcttccagtttcccgaacggcggtatccgcaatacgttcgaggcacgtggctactcggcatgggacccctcctccccggcattcatcgtagacgacacgctctgcatcccgactattttcatcgcctataccggtgagtctctggactacaaggcaccgttgctgaaagccctgcgtgccgtagacaaggctgccgtcgacgtatgccactatttcaatccggaagtaaagaaagtggttgcctatctgggctgggagcaggaatattttctggttgacgaagggttgtacgccgcacgccccgacctgctgatgaccggacgcacgctgatgggccatgacagcgccaagaaccagcagctggaagaccactacttcggggccatccccagccgtgtggccgctttcatgaaggaactggaaatcgaagcgctgaaactcggcatccccgtcaagacccgtcacaacgaagtggctcccaaccagttcgagctggctcccgtcttcgaggaatgcaacctggcggtagaccacaacatgctcatcatggccttgatgcgtaaagtggcacgtaaccacggtttccgcgtactgctgcacgaaaagcccttcaagggtgtcaacggtagcggcaagcataataactggtcgctgggtacggacaccggtatcctgctccacgcacccggcaaactgcccgaagagaacctgcgtttcatcaccttcgtagtgaatacgctgatggccgtataccgtcacaacggattgctgaaagcctccatctccagtgcgacgaacgcccaccggctgggtgccaacgaagcgcctccggccatcatctcttccttcctgggcaagcagttgagccaggtgctggaacacatcgaagagagcaccaaggacgacctcgtcagcctcagcggcaagcaaggcatgaagctggacatcccgcagattccggaactgatgatagacaataccgaccgcaaccgcaccagcccgttcgccttcaccggcaaccgcttcgagttccgcgccgtgggttccgaagccaactgcgccagtgccatgattgcgctgaactccgcccttgccgagcagttggtggaattcaagaaagatgtggacgaactgattgaaaagggggagccgaaaatctccgccatcctcgaagtcatccgccggtacatcaaagtctgcaaacccatccactttgacggcaacggttacagcgatgaatggaaagccgaagcagcccgccgcggtctggactgcgagacaagtgttcccgtcatcttcgacaactacctgaaaccggagagcatccggatgttcgagtccatcggtgtcatgacgaagaaggaactggaagcccgtaacgaggtgaaatgggaaatgtacaccaagaaaatacagattgaagcccgcgtgctcggagatttggccatgaaccacattatccccgtagctacacagtatcagtcggatttgattgacaacgtctacaagatgaaagacctgttccccgcagagaaggctgcaaaactgtctgccaagaatctggaactcatcgaagagattgccgaccgcaccgccttcatcaaggagcatgtggatgccatgatcgaggcgcgcaaagtggccaacaaaattgagagtgaacgtgaaaaagccatcgcctaccacgacaacatcgtaccgatgatggaggaaatccgttaccacatcgacaagctggaactcatcgtcgacaatcagatgtggacgttgcccaaatatcgcgagttactgtttataagatgaaaaatggaggatgaaggatgaatccttaatccctatctcattcttttgttggttgttttaagtttgcaggggggagaggtgccgcgaggcagttctctctctttttttcgtccatgccaactgttggcggtaagcgagaaataacctatctttgcccgtcagataaaacaatcctgtcatcatgaagaatttacgtaactgctatgcagcgttcctgctgtttgccttgctgttcgtttcggctgctgccccggcacaaaccgatctgcagcaaaaactgggtcggatttccgccattacggaaacccgtccgttggagtccacccggttctccgagaagtatgtaacctatttcacccagccgttggaccactgtcgtcccgaaaagggcagtttccgccaacgtgtgattgtctcccacgtcggcttcgaccgtcccacggtgattgtaaccgaaggctatggagccgcctatgccctcaatcccaagtatcgcgaggaactttccgagctgctcgatgccaacatgatttttgtggaataccgttatttcctggaatcccacccctgagcccaaagactggcaatacctcaccgccgagaattctgccgacgacctgcacgccgtccgcaacgcctttaaaagcatctatcccggcaaatggattgcgaccggcatcagcaagggcgggcagactaccctgctctaccgcactttctatccggacgatgtggatatttccgtgccttatgtagctccgctctgctacggggcggaagacggacgccacgagcctttcctcaggaaagtgtctactccggaggaccgcaaacggattgaggacttccagttggaagtgttgaaacggaaagccgcactgctcccccgctttgagaaatattgcaatgaaaaaggactcaagttccgtgcgcccgttgaagagatatacgactattgcgtgctggagtattcttttgccctttggcagtggggaactcccgtcagcagcatccctgccaccacggcctcggacgatgagatatttgcccatctgctcgacatcagtaatcccgactacttcattgccgacagtcccacagcctcattcttcgtgcaggccgcccacgaactgggctattacggctacgatacgaagcctttcaagaagtatctttccatccaatcgagcaaggattacctgcaccgcctcatgctccccgaagagctgaaagacatgcccttcgacaagaccctaagcaagaaaatcacgaagttcctgaaagagaatgacccgaaaatgatattcatctacggacagaacgacccgtggacagctgccggagtgacctggctgaaaggtaaaaagaacatccatgtattcgtcgagcccggcggaagccatcgggcacgcatcggcacactgcccgaagaggaaaagaagcaagtgatggagctgataaatgaatggttgaaacaataaaaacggatggtccgtgtggcatgaacagaccatccgtttactcctgacagaccatctgttctacctcaacagatggtctgtttttttattctataatttgtgcatcctcaatatcgtccactgcctttactgaagcatccggtgtcttcgggcggcgacgcgtaaacttgaaccagttcagcagttccgaagccgcatagaccagactgctgataccgataatgataaatgccgtggagcgtactcccgtaggattgaacagcgcaaccaagccggcaagcagaatcaataccggaaccacataaaaacctcccggtaccggcatccagcgacgggcagcggaaagcgaggcaatctgttgcactcctcccatcaccaggataaatcccaatacaaatgtcagcaaatcggcaaagaaaccgggcatgataatcagccacaagccaaacagcaggctgcccactccctcgatagggaaacggctgcgcatctccgtgctctgtgcaaagtagcctatgatgctgataagcgaaggcaccaggaaaatgacacctatcgtaatcacaaagtaatcacccgcctggtcgggaaacatcaccagcaccaaaccgataaccagcgcacatatagcacgcaaaaatgaataacttaatcctttcatgagtctatgtttttttgcgaagatacatctttatccgaataactccacacgaaaatcccgaaaaatcagtttacattcagccaggcattcatatcttcggccacaaaaagccagtataataacaacagtacagcaataaccacgcctatggcaactaaatgttttctattcatagtttgttcctttctttttttgaatgaatattcgtttttactacacttataagaacaatatttcaagaaaaatgttcttatccagaaaaaaagtcatatttattttggcagttaaaacaaagtgcttatatttgtcgcgaaaacgaagacaggctgcacctcagcataaaaaatgaacaagttcattttattatacattcggtttgcactgtctttgcccccgataaaacaaaaaaagtcaatgaaaacaatgttagtaaatacatattggtggtggcacccgttacaactccgacagtcgtaagggagcagcgctcgtatgtatatatgtaatatatagtaaaaaacaaaaagagccctgtcgcaccaagcgacggggcttttttcgtttaagcaataatgcgttttgatttctgaaatagtaaatagtaaatcgtcaaatagtaaataacatgatgaatttcttagttgacaaagaaggttattacggagagttcggcggggcatacgttcccgaaatcctccacaaatgtgtagaagagttgcagaacacctacctcaaggtgctgcaaagtgaggacttcaagcgtgaatacgaccagttgctgcgcgactacgtgggacgcccttccccactctacttggcacaccgcttgtccgagaagtacggttgccggatttacctcaagcgtgaagacctgaaccacaccggtgcccacaaaatcaacaacagcatcgggcaggtgttgctggcacgccgcatgggcaagcgccgcatcatcgccgaaaccggagccggacagcacggtgtggccacagccaccgtctgcgccttgatgaacatggaatgcatcgtctacatgggtaagaccgacgtagagcgccagcgcgtcaatgtggagaagatgaagatgctcggcgccaccgtcgttcccgtcaccagtggtaatatgacgttgaaggacgccaccaacgaagccatccgcgactggtgctgccatccgtcggacacctactacgtgatagggtccaccgtcggcccgcatccgtaccccgacatggtggcacgcctgcagtctgtcatcagcgaagaaataaggaagcagctccttgaacacgagggacgcgaatgccccgactacctcatcgcctgcgtaggcggaggaagcaatgcagccggcaccatctatcactacgtcaacgacccgcacgtgcaaatcgtcctcgccgaagccggaggaaaaggcattgaaacgggaatgacagccgccaccatcgccctcggcaagatgggcatcatccacggctcgcgcacctacgtcatccagaacgaggacggacagatagaagagccctattccatctctgccggactggactatccgggcatcggccccatgcacgccaaccttgccaagcagaaacgtgccatcgtcctcgccgtcaacgacgatgaagccatccgcgccgcctacgaactgacccggctcgaaggcatcatccccgcattggaaagtgcccacgcactgggtgcgctggagaagatgaagttcaagccaacggacgtggtggtgctgacggtgtcgggacggggggataaggatatagagacgtatttgagtgatgagtgatgagttataagtgatgagttataagtgatgagttatttgaaaatacgagatacaatgaaataaaatacaagatacaatgaaacaatatgattataaaacaatcagccgcaccatgctcggtgacttgcatacgccggtgagcacgtatctgaaggtgcgtgacatctttccgcagagcgcacttatggagagttccgactatcacggcagtgagaacaaccgttcgttcatcgctctgtgtccgctggctagtgtcagcatagaccacggcacggctatcttccgcctgccggacgacagccgcgaagagcatcccataaccgatgcataccgggtggagaatgccttgaacgatttccgcgcccgcttccgcgtggagggcgaatacagcaattactgcggactctacggatacacctccttcaatgctgtccgctacttcgagaatatccccgtgaaggacagccgcgaagctaccaacgatgcgccggacatgctgtacatattatataagtacctcatcgtcttcaacgatttcaagaatgagatgctgctcctcgagatgctggctcccggcgagaccagcgaactggaccaggtgcagaaggccatccataaccgcaactacaccgcctacgatttccgcgccgtcggccccaccacctccccacttacggacgaggagcacaaggcgaatatccgccgcggcatcgcccactgtctgcgcggcgacgttttccagatagtcctctcccgccgattcgagcagcgtttcacaggcgatgacttcaagctctaccgtgccctgcgcagcatcaacccttctccctatctgttctatttcgacttcgggggcttccgcattttcggctcgtctcccgaaacccattgccgcatcgaaggccgccatgcctacatcgaccccattgccggaaccacgaagcgcaccggcgatgcagagcaggacgccctcaatgcccggtacctgcacgacgaccccaaagagaacgccgaacacgtgatgctggtggaccttgcccgcaacgacctctcccgcaactgccgcgatgtaaaggtggacttctataaggagatgcagtattacagccatgtcatccacctcgtcagccgtgtcagcggaacgctccgcgaagaggccgaccccgtcaaggccttcatcgacaccttccctgccggtaccctgagcggcgcccccaaggtacgcgccatgcaactcatcagccagctggaaccgcacaaccgtggagcctacggcggctgcatcggtttcatcggactgaacggctcgctgaaccaggcgattacgattcgtacttttgtcagccgcaacggtgtcctctggttccaggcaggcggcggtatcgtagccaagagcaacgacgagtacgaactgcaagaagtgaacaacaagctcggcgcactgaaaaaggcgattgagatggcagaaaaaatgtgagtttatgtacgatttgacgatttacgatgtacgatttgccatgcggcgtacattgcgcagccaaatcgtacatcgtaaataaagtaacttcaatcgtacatcgtaaatcgtcaaatagtaaataaaatagattgtaaatacaaaagatgaaaacagttatcatagacaattacgactccttcacctacaaccttgcccatctggtgaaagagcttggcgcagaagtggatgtgctgcgcaacgataaattccggctcgaagaattggagccatacgataaaatcatcctctcacccggccccggtgtccccgaggaagccggactgttgctggatgtcatccgcacctatgccggacggaaacccatacttggcgtctgcctgggcgaacaagccataggacaagtgtttggcggaaagctggtcaatctggaagaggtattccatggggtacagacggagataaggattaggagtgagggattagggacgagggaggaaggattagggattagtgatgaaggattggggattagtgatgaaggattggggggaaaggattatgaaggtatttctctcgaagaagactatatcttctgcggtttacccaataggattcccgtcggacgataccactcctgggtagtggatacgaaggactttcccgaagcgctggccattaccgccatcagccccgaaggacaaatcatggcgctgaaacatcgggaatatgacatacacggcattcagttccatccggaatccgtactgacacccgacggaaaaacaatcgtaaaaaactggcttttcaaatgaggcacttcagaaaaagagtaaattcaatcgtcaaatcgtaaatcgtcaaatcgtaaataaaaagatgaaagcaatactcacccgtctcttcaaccacgaagagcttacgtcggaggaaaccaaacaaatcctcctcaacatcaccaaggaaatgtatcctgaggcgcagatagcagccttgctcactgccttccagatgcgaagcatcactgtggacgagcttatcggtttccgcgaagcactgatggagacacgcctccccatcgacttcgccccctatcgccccatcgacattgtgggtacgggaggcgacggaaagaacaccttcaacatctccacctgcgcttgtttcgtggtggcgggcgccggctacaaggttgccaagcacggcaactacggagccacttccgtgagcggagccagcaatgtcatcgagcagcacggcgtacgcttcaccaacaaccccgacacactgaaacgcagcatggaggagtgcaacatcgcctaccttcatgcccagcttttcaatccggcgatgaagtttgtcggtcccgtacgcaagacgctgggagtacgcaccttgttcaatctgctcggcccgttggtgaatccatgctgtccggcataccagctgctcggtgtggcagacctctcgcagatgcgcctatacaccaacgtattctataaactcggcattgactttgccgtggtcaacagcctcgacagctacgacgaaatctccctaacggacgagttcaaggtgatgacccgcaactacgagcgcatctaccgtccgcaggctctcggcttcaaggatgcccgtcccgaagaactcttcggcggcgcatgcaaggaagatgccgcccgcatcttcgacaatatccttacggggcatgccacacctgcacaaacgcaatgcgtcattgtcaacgccgcctttgccatccaggtgatggagccgcagaaagagattgaagagtgcatcgccatcgcacgcgaatcactggatagcggacgggcgctggcgacactgaaaaaatttatcgagattaataaatgaagcaatgaaagatatactgtccgaaatcatcgcccataagcaaacagagattgaactgcagaagcagaccgtctctccggaacagttgcaggagcaggccggaatcatcatccgggagaatgcggcccaccaccgcagcatgaagcaggcccttgccgcttcttctacaggaatcatctccgagttcaaacgccgttcaccctctaaaggctggataaacgaggctgcccaagcagaggaaatacccgcctcctacgaagccgccggcgccgccgccctctccatcctgacggatgagaagttcttcggcggtacgctgcgcgacatccgcacggcccgtccgctcgtccgcatccccattctgcgcaaggacttcatcatcgacgagtaccagcttctgcaagcctgcatcgtaggtgccgacgccgtactgctcattgccgcctgcctcagtccggagcagtgcagcaccctcaccacccaagcccacgaactcgggctggaggtattgctcgaaatccacagcccttcggaactctcctatataaataaggaggtcgacatggtcggtgtcaacaaccgcaacctcggctctttcgtcaccgatgtggagaactccttccggatagcccggcaactgcgcgaagccacccacggaccggcatccccgctccttgtctccgaaagcggcatctccgaccccgaagccatctgccgcctgcgtgccgccggcttccgcggtttcctcatcggcgaaaccttcatgaaaacagccaatccgggcgaaaccctgaaagagttcatccaagccagtctcttaattgataattaaaagttgaaagttgataattgaaagttgataattgtaaatacaaaagtctctcatacagcgttacatcgcgcagccaaattgtaaatcgtaaattgtaaatcgtaaataaaatgtctcctctcatcaaagtatgcggaatgaccgaagcagaaaacatccgcaatgtagaactgcaaggtgtagatatgattggtttcatcttctacccaaaatctccccgttgtctgtgccagatgcccgggtatctgccagcctgcgccaagcgtgtcggtgtctttgtcaacgaaagtaaggaaaacatcctgatgtatgccgaccgtttcagcctggactacatccagctgcatggcaatgaagctcccgagtactgccgttccctgcgcaatgcaggcctgcacctcatcaaggctttctctatcttgctgcccaaggacctgctttccgtatctgcctacaatggtctgtgcgactattacctcttcgacaccaagaccccgcagtacggcggttccggcaaccagttcgactggaacctcctgcaccgctacaacggtcccacctcgttcctgctcagcggcggcatcaacccctacagcgtaaaagccctgcgggagttccgccacccctatttcgcaggtatcgatatcaacagccgtttcgaaacggcaccgggaataaaggatgtggaacgcatctcaaacttcctgaaagaactcgatgggtttactatttgacgatttacgatttaccatgtacaatgtacaatttgccatgcggcgtacattgcgcagccaaatagtaaatagtaaattgtaaaattgtaaatcgtaacatgcagcatatattgcgcagccaaatagtaaatagtaaattgtaaaattgtaaatagtatgttgaaccgcattaaccaacttttccaggacagccccaagaatctgctgtccatttacttttgtgcaggctgtcccaacctcgacggtactgccgacgttatccgtgccctcgaaagaaacggagtcagcatgattgaaatcggaattccgttcagtgaccccatggccgacggcattgtcatccagaatgccgccacccgcgccctgcacaacggcatgtccctccgtctgcttttcgaacaattgcgcgacatccgtcgcgatgtccgcatcccgcttgtccttatgggatacctcaatcccatcatgcagttcggcttcgaagccttctgccagaagtgcgtggaatgcggcatcgacggcgtcatcattcccgacctccctttccgcgattacgaaaagagttacaaagccatcgcctcgaagtatgacatccgtgtcatcatgctcatcacccccgaaaccagcgaagcccgcgtccgcgaaatagacgcccacaccgacggcttcatctatctggtgtccagtgccgccaccaccggtgcccagaaagacttcgacacccggaagcaagcctactttaagaagataaaagatatgaacctgcgcaatccacgcatggtaggcttcggcatcagcaacaagcagacattcgatgccgcctgcacccattcatccggtgccatcatcggcagccgcttcgtcacgctgctcaacgagaaggaaggagatgcggaaaaagctatcaggcagttgaaagaagaggtaagaaagttatgagtgatatcactcatgacttttttcgctatctttgtaccccaaaaagaacccaaatacgaaatttatgaaagtcgattgcccttccgtactattgatttacactggtggaactatcggaatgatagaaaatcccgagaccggtgcgcttgagaacttcaacttcgaccaactgctgcagcatgtccccgaactgaagcgcttcaactaccgcatctcttcctatcagttcgacccgcctatcgactcttccgatatggaaccttccctctgggcaaagattgtaaaaatcatcaactacaactacgacaatttcgacggcttcgtcatcctgcacggtaccgatacgatggcctatacagcctccgcactcagcttcatgctcgagaacctttccaagccggtcatcctcaccggttcccagcttcccatcggcaccctgcgcaccgacgggaaagagaacctcatcaccgccattgaaatagccgccgccaagcatccggacggtactcctatcgtccccgaagtgtgcatcttcttcgagaacgagctgatgcggggcaaccgtaccaccaaaatcaatgccgagaatttcaatgctttccgctccttcaactatcccgcactggcaaaggcaggcatccatatccgttataacgagcacctcatccaccgtcccgacccgtcacgccctatgaagccgcactaccttttcgacaccaatgtcgtagtgctcaccctctttcccggcatccaggaaagcatcatcaactccgtgcttcatgttcccggcctgaaagctgttgtcctcaagaccttcggttccggcaatgccccccagaaagaatggttcatccgccagctgaaagaagccagcgaacgtggcattgtcatcgtcaacatcacccaatgccaaagtggcgccgtcgagatgggacgttacgaaaccggtctgcaacttctccaggcaggtgtcatcagcggctatgacagtacccccgaatgtgccgtcaccaaactcatgttcctcctgggacacggactggaccaagccgaaatccgccaccgcatgaattccgacctggcaggagaaatcaccaagattcagtaaagcagcaacacagagggtatatagttatattgacaattttcaaaataaacttgttttatctattcgcacaaaagcgttaaaaagggttaatcaccatgcttttatcccccattaataaagcttattagtttaaataaacgtacttttgcttacaatcaagcaaaacaaatgtaaaatatgggagaaaataccctatacaaacgctttctgccgcttgttattcttacagtaggcatactgctgcagggttgtaaagacgatgtttttaaccccgaaaaagtgaaagcagcctatcaagacaggtttccggtcaagaacatagacccggctatggattggaaaatgactcagcaggtccgggtcaatgtttctgtatccgaagataccggcatcgactataccatacgtatttacgacaagaaccccttaatcagccggtcatctgccaaactgctggcagaaggcaccgccaataatacaacagtatttactaccgtcatggactgcccttctgtactgacgagcgcttttgtgtgccgcaccgatacacacagccgcaacatagtaaaatatgtatccatccaaaacggtcagctccatgccgctttcggcaattcccttgcaactacacgtaccgcatggacgcgcagtgtcagcatcgagacctattcaccggaaaagtctgaggcggaaatcaccgcaatgctatcaagcgccgaagaaataaggccgaataccgattttcaaaacggaaaagcctacaaaatctccaaagacaatatatataggaataaaatcagcaaggacggcatgggaagtgacaatccggccatcatcatcattgaaggcagctgggaacccaatggaaacaacatgaccgttgaacgaggcttcgaattctatgtgattgacggaggggaaatcgtgataccggacgagcacaccttcactttagtgcaatccagccggtttatcgtctacgcgggtggaaccatcaaagggaacgacatcgaattgaccaatgcatccggaggcagctacaactacaatgccggcaccatagaaatagatgatttccatgtcagccagggaggagtattctataattgcggtaccgtacgtgtcgatgaaatgaatttcgacagcggatgcaaattcatcaaccagggcaaagcctacatcgggaaaacccacagcaacatcactatagacaacggatgctatctatatacggaagaatttgtaggcacactgaacatgggagacacctcttctgcagagatagaggatttcggggaccatagcaacaattacaacaccagaatcacaatgggtgacaactccatgataaccgtacttgatgaagcagaattgtcacaagcacaatttatgggctcaaacaatgaatatgcactggtaaaaatcaataaagttgaagatatagggaatttttccagccagggaaacattcattatgaagtgaaagaaattgacgatgatatcactgaggacatctggtgggaagccaaattccttgatgccatcaagaataccgaaggaaccatatccaaatggggagaatcccccatcaccattcccgccggagactgcacgggcgaaggcaatactccgaacgagtccggctcagagccccctacagacccagtctcctatacgtacgtattcgaagacaacttcccgttggtaggcgactatgacttcaacgacgtggtcttggacgtggagacctactatcaccgcgagaaaaagacgaaccacatcaagcgcatacagctcgacgtgacccttactgcggcaggagcaagcaagccgttgggcgtagggctccggattaccggaatcaataaatccgatatccgggaaatcaagaccggaggcgacgattcgcgtttccaggagtcattcaacagctcgtacaacaaattcaggtacaataacgctacttatatggaagattccgatccgaatgtcataatccccatcgcaggcgaagtacacaatgtatttggagttgaatcgggtgagatggtaaataccggcattggagtgaccgccaaagagtatacttataaagtcattattgaactggcagaccaaaaccggacagaacccctattctcaaaagacaatctggacttcttcatctgttatcaatataaaagcatggaacaacgcatggaagtccatctttacgaattttggggatatggcgccactgccgccggaaccatacagcaagagaatcttgacttagcaggcaacaacacatgggcaatctgcgtgccgtatggcttccgctatcccaaggaaaccatcaatatttcacgcactgatatccccgaagcaagcgcatatccggaattcatctattgggcccaagacagaacccagtatacggaatggtacgaacacccggtagaagaaaatgtatatagataaatatagcaaacaattatcataagcaatgaaacaaatattatttgtagatgacaaacctgccataggcaaggtactctcggtctatttaggaaaagaaaatgagctggtctatttcgaagatcccgtcagagccatagaatggctgaatgaggggaacgagcccgctctcatcatttcggacatacgcatgcccaaaatgaccggaggtgaatttctggcatatctgaaaggcaattcactgttcaaggacattccggttgtgatgctttccagtgaggaaagtaccaccgagcgcatcaacctgctcgaagcaggagccgaggatttcatactgaaacctttcaatcctatggagctgaaggcccgcatcaagaaatttctctaaacaacaaaatcaatggatatgttatattatatctacataggtagcaaccgcgtcaccatcggccacttgagcaaaattgcgggaggcatgttcatggctgtttcatcctgcaacaaagcggcgaaagtcatcgacggtatccgcgaacggtacaacacatccattctttacgaagaaagtacccctcaaaaggacagccaggacatcactttcctgcacaagcgcttcccccgtgtctacatcatcctcatcaccgaagggttgcagaaggaacaccgcaagctctatctgcaggcaggtgtcaacaacaccctttcccctatggccagcgaagagagcctccagcaaatgacgaaattcctccggttgcgcaaggagcacaaactgcaggaattcagccagtcacaccgtaagatattcaacaccttccacctgcctatgtggaaacgtatcttcgatatactgtttgcgtgtgcagtgctcgttgtgctttctccgctactcattgccacagccatagccatccgcatggagagtaaaggcaaagtgatttacaaatcccagcgtgtaggcagcaactaccagatattcaacttcttgaagttccgctccatgtacaccaatgcagacaagcgcctgaaagaactgaatgccctcaaccaatataagatagaggaagagcttacggacgagcagcccgatatccgcttcgacgacctgaccggcacttccgaagaggaggctaccctgctgatttcggacgattttgtcatctccgaagaagatttccttaaaaagaaggcccaagaaaaacagaatacgtttgtcaagatagagaacgatccccgtgtcacccgcgtaggccgtttcatccgcaagtacagcattgacgaactgccgcagctgttcaacgtcctcaaaggggacatgagcatcgtgggcaaccgcccgctccccctctacgaagccgagctgctgaccagcgacgcatatatcgaacgcttcatggcccctgccggactgacaggactgtggcaagtggagaaacgaggtggcgccgggaagatgtcggccgaagaacgcaaacaactggacattaaatacgccaaagaattctcattctggctggacatgaagatactgtgcaaaacgctgacggcatttgtacaaaaagagaatgtataaaataaagataacaggaattatatggctttagagacaataaaaagatatatcagttccatcatttacagtgtaatcctcttaggattgttgggggtgtctttgtctgtggctgcgcagcaggagttgacacgggaggagcgcatcaagatattggaacagctcaaaatggaggacaaaaaaatagaagtcaacacattgggtttaatcagttcgaagacatcaatagatattgagaatttagagttgcctcctctatccgtctttcttgatgcagtaacagagaatgcgtcagtaaaaagagcccaatcccaagtagagcaagtcaagaaccaatatcgcctggaaaaaaggaattggtggaactacttcaggctgaacggtaactattcttacggacgctacaacatcataggcaatgccagtgacgagttcacccctatgtaccagacaacgatgtcaagtgcccagcacaacttcaatgtcggggccagcgtcggtgtcagcctgggtgatctattcaaccgtccgttaaaactgaaagattatcgctaccagatagaacaattgcaatatgtacaagaagatgtcatggaagaacggagactaaaggtcttggaagcctacaatgcagttaccgaacaattagccaccatcaaagccaaagcagaaacggctgccttgtataatgcacaaatgaaaatatctgaaaacaatttcatacaaggagccatcgacatcattgcactttctttagagcgtgcgcgccgcaccggtgccgtgaccacgtatgagcagagtcgtgtagctttacacaattcaattgtattattggaaatgttgactaatgtaaaagttataacagacaagtaaactaattatgaatatagtacaatttttggcaagcttcttttaccgcatccgttattggttattgtggggaagtcttcttgttacggcattggtcatatactttacccaatttttaccatacagttatacggtaaacagtagtttatatgcaggcgtaaccaatagtaccaatttggatggaagccagcttatcaacatcaacagtactttcgacaatatcattaatattggcaagtccaaaaacactttggcaaaggtttccgttcgactgcttgcaaccaatcttgtacacggtgatgaatggaaagacaatatgtacattcaagccaaacattacagacaacttgtccaaatccttccaaaagaagtattggctttggtagaccgttcctctttggataaaaccgtaactaatttaatgaattacagaaaggagaacagtagcaattttgtctattccatattcaaccgcccttatccgttttatagctataacgcattaaattcaatcaccattaaacgattgggtaccagtgacctgatagaattggtatatacctcctccgatcccggtattacgcaaaacaccctcaagatattggaagatgaactgttaaaggcttatgagcaactccggttcagtgccacaaacagtgctatcgcctattttgaagaacaagtgcgaatagccaaaaaagcacttactgcagaagaagatgatttgacagactatagtgttcaaaaacaagtcatcaactacgacgaacaatccaaggcattggctttgaccaaatatgcgacagacgaccgtatggaagcagtgcaacgaaattatggaagtgcagtagccttgcgccaaatgttagagaataaaatggacatacgggccaagattatacgcacaaatacgaatttattacaagagttggaaaaagtcagcaccttgaaccaaagcattctcgaacaagaaatttttaccacagaacaaagtcagaagaaaagtgataaacttcaaagagaaaaagatgctctgcaaaaggcagaagaaaaaataagccatctctccgataatttaaacgagtatggtttctccaaggagggtgtaggcattcgagaaatggtgacagaatggctgacggcatgcatcaatgaggcgaaagccaaagctgaagtgaaagtattggttgaccgccaacgggacattatcggccaataccgggaattctcacccgtaggcactcaaatcaagcgaaaagaacgtgccgtaggcattgccgaagacaattaccgccgacaaataggaggccttgctgaagcacacctccgtttgcagaatatcaagatgacaactgccaacctgcaggtcatagcatcacccgagtatccgctgacagacaatggcagaaaaagaattatctacgtccttgcggcattcttcggcagtttaatattcataagcggttacttcctgctgattgaattgttagaccgcactctccgagaccctgaccgcagcaaacgtctgaccggactatctgtcattgcagcattcaacggtgtaagcaacttaaaattccgtggattcctcaaggcttgcaaccggcttgccgcagcctacagttgccgacaattcaacaactacttacatccggatcgtcccaccgtcataaacctgctcagcatggagaaacgtgaagggaaatcattccttgccaaatatttcatcgattactgggaaactgagggtatgaaagtgcgccttgtaaaatacgaccacgatttcgacacccaaaacaagggatatgtacaagctcaagaattgtctgacttctgggctttaaatgaagcagaagaaataccggacattattttagtggaatatcctgctgtcagtaccgccactttacctatgtcggtattgaaaaaagcagatttcaatttgctgatagccaacgctgcccgattgtggggcagagatgacgacacccgattgaaaccgttaaaggaagaattggaaggaactcctctatttatgtatctcaacaatgcagaccgcgaagtggttgaaagctttaccggagaattacctcctcatactccggtccacagtttcttcagccggttggcacaattaggtttaacatcaaaatcagcagctgtcaaataaatgcaaacggatatcaaaggacatagcatatctcccttggcggtaacattattagtgttcatcatcggactgggtgcactcatctatagcatattattcagtacttgggatatcattgcatacgtttgcctttcccctttcttcttgataatagcaatacaagcattaagaaacccttttgccggtgtatgtttcctattcacattcaattactttttcattccctggtacagatacacgcaaggtagtgggttgagtgtctggtatgatgttgcaaccgtcaccctgcttataacacttttgatatattcctatcatcaacaaggtaagattgcatggaaatacaccaaaaatattctgacgtttggaggttgcatatgggccatatatactgcggctgaaatcataaacccaacagctctcacggaagcttggatttactctcgtggaatcatatacagcacccttgtcatgtcattaattggcgttttaacaatgacctcctataagcgattgcgcatcattatgctttttctgtccatattcacattgacagccgtagccaaaactgtttaccagaaatatgtaggttttgatgagacagaaacaaccatgctgattgaaacggaaatgtacaagacacaccttttatccgatgtcacccgatatttttcctttttcacagatgctggaaatttcggttccaacatgggttttgctgccattctgttcggtatctcggctatcttcgtgaaagaacgtttcataagactctattatataattattgccctttgttccatatatgccttgttcatttccggaactcgcggtgcactgtttgtccccatcggaggaagcatattgtttactttcctcagtaaaaatatcaagctcatgggagctacagtcatattcggcttatttttttatatctttttcgcccatacctatatcggtgaaagtaactcttcaatcagacgcatgcgcacagctttcagacctacagaagatgcctcatacactgtccgcaaagaaaaccaaaaaagattggctgaatatctaaaatacaaacctttcggagaaggactcggtttgggaggggtagaagccagaaaatatggttcccgtctcacaacactcattccccatgattctttttatgtcaagatatggatggaaaccggtattgtaggattagtgctttttcttaccatatatgtcagtacattgttaagaggttgctatcttatcatgtttcggattaagaataacgagctacgtggaatactcacggccattgcttgcggcattttcggactaatgataagcgcctatggaaatgcttttttcttccaattccctacaggattcatggttattttatttttgtcagtcctgattaatggggagcatatcgaccaactgctgacccaacaaaaaatgaaaaagaaatagaaaatattaaatagaaaacatatatgaacgacattttttccatattcaatcccgactggtggatggacgagaacaacaatgccttgcaaatgacagacgcggttcttttcttattgctggccatccccgtagcctacttgtttatctatgcattggcctccttgcggaaatacaagaatccctatccaccgtcccccaagcaacatcgtttcctggtcctctttgttgtgttgaaaaacggcaaggaagtgatagagtccatcaatcatttccttgatacgcagatgtatccgagagaaaaatacgacatcgcagtagctgccacacaactgtccgaagaagacttagttacgctgctccagatgccggtcaatattgtcgtgcccgataaagagcattgcacaaagatatatgccatacagcaggttatggagcgttattctcctcatgagtacgatgccatcaccatattcaattcagacaacaaagttgttcctaacgcattggagcttttcaacaacgcctactactccggatgcgatgccatccaagcccaccgcatgacggaaaacctgaataccaacatcgccgtattaaacgccaccagcgaagaaatcaacaaccacctcttccgcaaggcacatacggcactgggattctcctccgccctcatcggttcgggcatgatgtttgattttgagatgtttcaggaaatcgctcccagattatcaggaagcgatttggccaaagctacagaaatggaactcttgaaggaaaacatatataccgaatacatggaagaaatagtctgctattgcaaaaagacggacgatacatcggggtacagcaaagaacgccaacgctggttgggctcacagtatcgcagctccatactggcattgcaacaatttccgatagccttcttacaaggaaagtgggatttatgcgaaaaattattccaatggctacttccatcccgttttctgctcatcttatatatcacgatatgtgccgtggcaataacattcctggagtggccgcttgctacaaaatggtatgcacttttagccgttttattcatcacttttttgatggccatgcccgaaggggaaatcagccgcaaattccggagcgctttctggtctctgcccatattggtagtcacctcttccatgagccacatcacaagaatctttaaacggaaaaagaaaagaaaggcagcaaaatgagaatcgccatcgaagcccaacgcattttccgcaaagacaagcatggtatggactttgtcatcctggagacactgaaagaactgcaaaagcggaaagacagtaatgaatattacgtattcgttgctccgggggaggaccggtgcctggaagaatcggaaaacctccatatcattgagctttgctgccctacttatccactgtgggagcagatagcattgccccaggccgccaggaagctgaaagcggacttgctgcattgtacatcgaacacagccccgctatggtgtcccatccctttggtgctgacgcttcatgacattatctatctggagccgcgtcagcatcgcagtccttccttctatcaggaaatgggatggcattaccgtcgcctgattgttccccgcatcctgaagaaagcaagaaagattattacagtttcgcagttcgagtgtacccgcatacaggaagctttgcagcttcccaaagaagtcattaaagccgtgtacaacggctacagcgcttactttacgatgcaggaaacacccgataagagtattgtgcagaaatacataccgcatccggactttcttttctttcttggaaatacagaccccaaaaagaatgcggcgcgtaccctgaaagcatacgcgttatatctgcaagcatcccaaacgaaacgcccccttctcattgccgatttaaaagaagaatatatcgaccagcttcttcagcaagaaggaatcaccaggataaaaaaacatctgtattatccaggatatatcggcaacaaagatttagtaaccctttataatgcagcatttgcattcctctatccttccttgcgtgaaagtttcggaattcctatgctggaggctatggcttgcggtactcctgtagtgacgagcaacgtttcggcaatgcccgaagttgccggtaaaggtgccattttagtcgaccctcaaaaaccgcaaaaaatagcagatgccttgctacgtctggagaatgatgcaacattctatcagcaacaagtaaattacagtctggaacgtgtaaaactgttctcctggaaacacacagcagaagaatatgtaaagatatatcacagtattcaccagtaatcggcaaacatcatgagagacttcatcatcaccagcctgcaaacatgggacatcgaaataggtagtaccatcaagaatactgcattggaaatttcaaagcagaaccgggtgctctacataaacactccgatggacatttccatccggctgagaggggacagacaatctccgtcttacatccggcgcatggctgtcatcaagggagagacttcaccgctccggcaaatcaacgccaacatgtggatactggactgtcctttcacagtgctctcggccaatttcctgcccgcatcgcttttcaatatcgtcaacagaaaaaacaatgcccgcatagcccgatggattgtagagcaggccaccgcactcggcttcaagaattacattcacctcattgatacagacatttaccgcagccgctatctgaaggagtatattcatccggctgtcagcatctattatcggcgcgactacgtcataggcgaagcttactggcgcaggcacggcacccgtcttgagccagaattagcagcctctgcagacattgttctggcaaactccacccgttttgccgcagagttgcaagcctacaatccccatacctaccccatcgaaaccggagtaaacctgacgctatacgaccccgccaaagagtacggaacacccgatgatgtacaaaatattccacatcctatcatcggatatatgggtacgataaacagtacccgccttgacggagaactgctttatcagataataagtcagcgtcccgattatagttttgtgttcaccggcccggaagatgacattttccgtcgggaccgtatccatagtttgaaaaatgcctatttcaccggacaaaaaaaagtggacgaattaccggcctacatagctgcctacgatgtctgcatcaatccgcaaatggtgaacaagattaccaacggcaactatccgttgaaaatagacgaatatctggctatgggtaaacccactgtcgcaaccagtacccacaccatgcgcaacatattcacaggtcacacgcacctggccatcaacccggaggaatggcttgcggccatagaccgtgctgtgaccgaagctgacgacaaagaactggccaaacagcgcatagcctttgccgagacccacagttgggggcatagtgtgaagaaaatctatgaaataatcgactcattcctaaagaagaaaactacatgaactatcgtaacatagacgacttgaaccattgcatcctgcaacatctcagcattctgccacgggatttcgacctcattgtcggtgtaccccgcagtggcatgtttcccgccaacctgctggcactctatctgaacctgcccgtcacggacattgattctttccgcaacgggcatatttatcagaccggagaacgggggaaaactttcaacatgacccacatacacaaagtactggttgtggacgacagcatagccacgggaaaagctgtgaagaaatgccgcgagctcctgaaggacatagaacatttatacaacatcaaatactgtgccatttatgcagttccactacacactcattctgttgattattttttcgaaatagtcgattatccccgtttcttccaatggaacatcatgaaccactctattctgcaaaaaacgtgcatggacatcgacggtgtgctttgcgcagaccccactccggaagagaacgatgacggcgagaagtaccgtcatttcctgctgaacgctcttccgctattcattcccaaagtcaccattggcacactggtcacttcacgcttggagaaataccgtccggagacggaagcctggctccagaagaaccatgtgaaatacaataagctcgtcatgctggacctgccggatatggctgcacgccaacgggcgaattgccacgcctccttcaaagccaaagaatacggttcatccaccgactacatgctgtttgtagaaagctctatgccgcaggctgcggaaatcaaccgcctgaccaagaaaccggtgctttgtacagaaactttccagatgatttatgaatccaaatcactatactataatctgaagtcgggagaaacattcccgtggctacggcgttttatgataagggtgcgcaacagactgagagcattatctccttccaagaaatagcattcgcagcattttggaacagttaaacagtttgtctactaataccggcccgattgttgcaataaaagttgcagacagcaatatggggacaatcgcatcaatccccatcattttcagtataatccgcccaccggaagtaccgaaaccatgaaaaagataaatactgtacgcatagccgcctatccagacaaaaaaacggttgtgccacttcaatgccagcagcaggaacaaggtgggaatcaacgtcacgggataaagcaacatgctcaaagaggcgtatttaccgggatagaaccacactatctgtatcaagacaatcccccatagcgccacggcaagcaagacacgcctgacagccagacgactgtagagcgacacagcaaaacggcaggcagccacgccgacaaagaaatagggcaactgtcccaaagcgcccttgaaactgaacaggtcgggaacctcatgcagaatccatacatcatttatcctactgaaaatcagcgccacaatgcaacaaacagcccacttgcccggagtgtccatccacttccggctgtccatccaccattgcactacaaaaatcaagaacaacgacggcagataccaatatatggtataagggaatacataaatgcgccacatttggctaagctcccctttattattagtgcccggcatcagatactgtaccagaaaatacaacgtgcccaccgccgccatcggcaccagcagacgcaaagctttcttccggacaaaacttccaaaaccggaagatgcagagaaaggcttcaacgcataaacccagccggcaatagccgtaaacaacggcatctgaatataatctatccatacgtaaagataacgcaatggatgtggaaaatcaattttcatgcccccaccaggtccggaaccgatgacatgccccaccactaccaataaaatagcgataccacgcaaagtttcaatagataagtttttttcctgattcaccatgaaacaaatatagtgcatttgttcgaaagaacagaattaaagaacgtgaaaaaagaacggatttaaagaaccgccttatgtatctcttaaaggtcttgcagaataatacaaaagtaatttccgtttaccgaaagctgagatttgggataacacgtgagcatattaactatcttccattataaattcaagcatagagtatgaggaaaacaagagatgtacacacaagagtaagtgtctgttttactaaatataattaattgttaaaacaacaatgaattaaaaaaaaagttatagatttaaatcgtcaaacaatatcaatttaaattatgattgcaaatttagattgcatcagttaataattttctaaaactttttttataatggggacaaatgtttttttaaaagccggtttgcggaattcagatagcaaacgtttttttaaaattctttgggtggttatacttgcgttatatccttggttattgtctgcacagacgtttgctaaggcaaagaaggcagtatatgtaattgttgacggaattcctgccgaccagattgaaaggcttcatacaccggctatattcgatattgcttcaaaaggcgcttacagtcgggcatataccggaggagaaattggtggatattcacagacggcgacaatctcagctattggctataccaatctgctgacagcaacttggtttaataagcataacgtaggaggcaattccgacctgaaaccgaattacaattactggacgatctttcggattgccaaagagcaacccaaaaaatataaaacggctatctattccagttggacgaataaccggacagttttgattggggaggggaaaaaggaaacaaactatctcaagattgattatgtaaaagacggttacgatttggacagcatccgttttccgaaaaaagagaaggatttgcatattttcgatatagacgaacaaatttcgaaagatgcagctgaaggtatccgcacagatgcgcccgatctgagttgggtgtatttatggtacactgacgatgcagggcatattgccggtaacggagcatttttcgatgaatatgtgcgtaaagcagacgagcaggttgcccgcatttgggaagccgtgaaatatagggaggccaattttgatgaagaatggatggtcgttattaccaccgatcatggacgcggagagaatggacacgaccacgggggacagtcctggcgtgaacgtacgacctgggtttcaacgaatgtaccggtaaacagtcatttcacatccggcaatttggcaatcaccgatattgcaccttccatctgccggttcatggactttgaggttccacaatctgtcttgtgggaacaagatggcatgtcctttgtcggggatgctgacatttacgatttgcagacaatgccttatgataatacggtcggtttatcctggaaatgttattcggagaatgttccagtgaccgtttatgttgccgtcacaaataaattcaaagagggagatgaagacgaatggatcaaattggtgacgctaccggccggaaagagaagttacacagtcgatctacaagctttgccagaatcgaagttctataagtttgtcatcgttgctcctggtaatcacttgaatcgttggctagaaaaataagggcatgcaaaaaccttttctgtctaaaggagcttacaagaaccaacaacaagtccaatgggtatttcaggaggtttcttatcgttccgatacccaggtcagaaatggatccgaagctggctgagaagattgttgatacagagttgcccggaattacgaaccggagaaggaaatcataatccgactccggttattttttatgtttccaagagtggtaatttctccattctggtattcattcacgacgaaatgatcactgacctcagaccgagcaccccaagatttattcagttgttcaattgtccgattgatttttttgcattataaatcaggtagcaggcgaatatttttaacgccaaagtccttacttttatcaaaaaatacatattaaagattttctttcatgaagtaaaaaactatagattctttttttccttattcatcaaaaaccagatttttcgctgccattcatacactgcaaatctctcatcatcggagtcgtcagtcttttccacatatgttcttatacttggggcggaaggatatttggcccggataatatcatctatcagatagccgttcagccccttgaattgcttgaaaaggaaacttttgaacataaggttgatatatataggattattgcatatatacgttttatatgcctgatatgctttagacttcatatagtctgaaaccctgctgctgaaattgagtttaccaagctcttcttttaatgcctcttccagttttttatactcagtagagtccgttatactgtaccaataatgttcatcgggtttagttattagatccacccatgcactggcttcccaataatcggttaccattcttatggaatctctttgttccggagacatcgcgtaaaacaaggagtctttttcccagccttcaaaaagagcttcaatagaattgatcttctcttgcttcagtcgttcatatatatccggtaattctttatcaagaatggaagttatctggaaagccccactttctattctacaattaacacgtgtattggttatgatagagtcgttgaatacaaaagcgatctgcctgcctattgccttttccgtttctttagcccatttgttcaatttgtatttactgatttgcccactaatcacatttttcccaaaatagtccgtttccaatctaagtgaaataaaatcttttatcgtcacgataggttctcgggagatactatctgtttgtccggataaaatatgataccaaccattttcccgaaatttattttggcaaactgaaaaatatggaaggaaagaaaacaatgccaatattccaaataattttttacacataacctaatgttttttaaattctgatttcaaataccgttctccttcgggtacaattctaacagagttccggacacatacacttattaagattcaaaaaatgatgagaataacaacgacagtaattgttacaactattattttttatgagttccgagtatttcatgctattcattgtagaaatcactattaaaccgaaattctaaaagtttacgcaaatttaataataaaaacaatcaaaaagcatgatatttatatattgtctaaaaaatgccccaaaatcatgcagtcatggatttggactttaaaaaacaataagtggaatgccagcttcaagaacatcactatcctggttccttcattagtgatacaaactacattcttctcttattgtatcaaagccattgcagaaaagacatcagcacacatgcttttatcaattctaaatataggatataaaataatattcaatacctttgcagtataggttaaacttattattcccgccaaatacttttagtgtttaaatcatgaaaaagaaaattctattcattcaaacgtttggtttctttgccacttatctttgtctcgatttcctttttacagaagaagttcatataattgaaatctctttatccgctgtcatgtattttgtactgatgtattttctgaataggaataagaagtaagtttttacaatgcgatccatagaataaggaatctccaccttattccaatggtgctgtattattcctataaaacttcatcctcttcttattttttcataccttcacaccattttttaagtacaaacgaaaaaacaatggcaatcatggaaaaaaatcaatttaaacgtgacagataaatcctgaccacacgcacggaatggcaacaccactcgctccgcgtattggtacgtgctttgctgatggactatccgggagcaaaagtagcgggacatcacaacctcagtcccgaccataacaacaacggagaagtggaaccgatggaatggacgaaacaatgcccgtgttttgaagtgaaaaaagagaagtggtaactaagaaaatggagatggcaaagcatgacaaaagctttgtcacctcattttttattcatacatctgttctaattaagcaaaatgcgcatccaacaaagtttagccgtataatataaatgagagagtaaatcttttactacctccaatgattacttctgagccctgaaaatctttcgataaaaattaagttttgtaagaatgctccgtaaccatgtacgcttacgccaacttcctttacttaaatgaacggcaatagtatcatctgtgacttgtttccaagcagctcctaatatacgagaaggaagaatgagcattctttcttctaattgttgttctatttcattattatactttaatccgaatttttcagcagccaacgccagcacatctggtgctatctcctttgtataccaactaccgtcttcttgtataaaatggcgaccttcatagaatttcatagcttccactaaataaggatgtcccctttcagctcctaatatggctgataacaaacctaagcctggtacacgtacaccagggaaacgatttgttccatccggtccaagacgtttacctgccatctcatctccctctatcatttccggatgatattctatagcagtaaaaaagccattggataatagtggatcaaaagattttttcaccatgacatcggtatccatatatattcctccttcggtatataatgcatgtaaacgcacataatctgccacaaaagctaaagcacctacactaaaggcctctttggtccatgacaaagaatttacatcaaaatcctttaaactccataatttccatttatagtcagggagatttttcttccatgaatccatacacacctgtaaactataaggtatcggcgtatcattgaaccagcaataatgaatcgttttgggtatcatttcaagtcatctttagattattttgcaaaaagcctaccacacaaagataaaataaaattctaagaatcagcataagaataacgaaataatcgtcctctatccatacacacagctttccaatataacgcatcatacaccttgaaaattacaaatgaataaaacgtcccaacaacgttcgaataccctttgaaaagcaataaaagaaaatggttaaaatcaccaaaaataacagtgaagaaatcaaagcatagaaaatccattccaagtagccttccataggttctgataaaggtaataatgaaagaatgacatccgctaatagccaagacaaagcacacagacataaatacaacaagatattcttccaataaacactaacgttcattttaaaaccgtcacgatataagaaataaggtttccaaatgcttatgacagttatggaactggcaacatcccccagtaacactcccggcaacccccaataatacccgccaaccaatgctaccaatatcgtaattccaagtgtagcaataggcgcccaagtatcttgaaaaagcccataaccataaataaactgatcattcgtgccacggaactgactgataaaaaagttggcaagaatcactatcaatacagaatgaggcagcacatactctgctcctaaccatacaataataaaagaatccatcaaatgatagagagcaaatgttaaaaaggaagctaccataaaacgtaaagagctgagttcccaaaatacttgttgtatgcgctttgagtcaccttcggcaatcaaattacccactcctgctcccgtacttcctaagaaattattaacgagctggttcaatttcgtcaacagcaacatgtaattgctataataggctaccaattttaaggaagtaaacgcgtaaaccaaaaaaggaagtaattgagaccgccccattcctgccaattgatgtacaaacatttggcgtgccttgcgtacgattatcttattctccggatattttcgacgaccttcagcaataccacacttcagccatggatataccctatttatcttccagttaagtatatatgaatataagatgccaaaaagtaattcaatggcaatccatagataaaaactacctatgtagcaaacaagcatcatctgtaccaatatctttataatatttgcagtctggaaataggccgttacaacataattacgttgatcggctcctaacaaagtttgccgataattaataaagtaactgatgagggcagaagacaaaaaagcaaaataggcaaaatagactacacctaaatcaatactgatatttgcaaatatcaaaggaagaaaacaagccaatatgagccctacccctataattatcaatccgacgttgcgataaagataccccaatacagaaataatatctcgtatcttgtccttgtcatcattaaataaaggtttataaagtacaaaaccaatagatgccccaattcctaattcggccaaattcaagaaacccaataaattttgtaatgtccccattagacccacaaaatctgctcccaacatatccaagaatatcttgcgagaaaaaaaagagatgaatagggtaataaaataaaaaagcacatttacccgggcattcaaatagctttttttgagacgagactctaccataatttcaacttttcgcaaatatttttcattttatccataaaaacacccctaaaggtaccatacacgatattccattgttcattgcatataaaaatccacaaggctttgtaatatccccgccttccgaaatactttctgcattgcatcacacggtaatagctgctcacaagtctatcttcccgatttatttttctcagaaaccggttacagcgacatgctacccaaacccgtgccaacaaattgtcgagcaaaacactatattgtaaagaaccctcacgtattgtagcacaataaatggctacagagcatattgccacattccgagcgtaataatccaaataataagagaacattacatcatttccagccaatgtctcatcaaattggatggaatgcttctgaactatatttctggaaaccatttttgcccagggtacatcattccgatattttagtctctccgcatctatgctttcagtcacatcaaaacctaaaaaatcagattgacgtgaacgcataggaactaaagtttccgaatctgcacttgtagctctgaatgttatcaaatcgtagtccgtagcacaataacaatccagtacctctaaaaaaccgggcagaaaaaaatcatcagcatcagcaaacagcagccacttgcctcgagcatgaagcaggccacaattacgggcatatccagctcccttcccttctttggtgaaaatgatttctacatcttcccgactacttcccggaaagtccataaaatccacgacatcagaagaactgtcatcatcaaccacaataatttggatgtcatcacggaaaggaatagaatccaaacagcgctgcaacaacaacggagcattcttatgaggtataataatagtataagtataatccatactccttacttttgacaacaaatcagttaatacatatgtttaggcccataaaacaccggccctatattcaaacggaacaaaagacgaatatagaaatcatataatatatagcagttgaatcctaaaagaacctttcccaatttatctgtcttaaataccggatgataatatttcaaaaagacatccctactttctgaaatcatcctcttcagatgctttaccctcatctcacgcgggatagtcctatccggctgataatcacttttcaaagctcttcggaatggaaccagcatagaattaactgtaactaccatatctcccgctggtattttccatactttcatcatttctgccagaagctgttgatatttcacgaaacaacagtattcagattcaaatgaatgaatacggtgggatagtgaaaaggaatgtttcacgtacacataattctgcatatggttcaatacaagataatcacaatgcaacaagtactgatacataaacaacaaatcttcaagacaatgtatattctcatcaaagcgaattgaaaattcttctattatactccttgcataaatttttgacacagcatatcccatttcacaaatattattctctgcaaaagatttacctatactggagaaaggcaaataacggtccggcaaagataaagaaggcaaagaggtaccatcagttctcctacacaacatcccttgaatcactaatcctcttcctgaataggctgcctgcaaattataaagccccaagcaataatcaggcagtatccagtcatccggatctacaaaaaccacatacttcccggtggcgtgatccagccctcggtttcgtgcaacactgactccagagttctcctgatgaaatactctgacacgataatccttagatgcccattcgtcacaaatttctccacaacgatcgggactaccatcatcaatcagcaatagttcaaaatctgcaaatgtctgcgaaagaatactggaaacacagcgcgacaaatattgttccactttataaataggaacaatgacggatataataggttcttctttcatcttgaatttctatctatattatcatatttatagtcaatgcatcccgaaactttttttgaaccggagaaaacgtaacaaagaaatccagcaatcaaagaaaccgcctcccatgtggcaaagaagatatttcgctatgcaatctgctttataatctggcatgaatctttcttctatccattccttttccttggacaataaatcgtccagacaagccacccgctgcctgaatgggtagccattagtatggagggatagcagtacacgctgaaaaaccagacttacggagtgcctcaaatagcagataagttcatccgacaggcaacaaacgtcctcaaatctttccattctgcttctataagctgaaaaaatattgtactcatcgctgtatatattcatacgggaagaaagcgtttctgcagaataggctatcctataattatagtccatgaaattgcaaagacggatataatctgaaagcaatatgtaatctatcataaaaatcaaatcttccatgcaatggacattacaatcaaaacataatttattttcacgaatcaattctgcactatatagttttgaacaagaaaatccaaaacggtcaaggccatactccgcgaaaccttcacctatattacttcctatgaatatttctggaagtgtaatctttcctattaacttaccatcaattgaatattttaaagctcctcccagcaccaaaccaatacccgtatcgggcaggctcttatataaatgcaacaaataatccgtggaaacccaatcatctgaatccacaaaaacaatatatgtacccttagcatgctgcaatcctatattacgtgcagcgctaacgccactgttctgttgatggaacacccgtatcctcgtatccttcccggcatactcttcacaaatctccccgcaacggtctgggctcccatcatctaccagcaacaactcaaaattcgtaaaggtctgtgcaagaatactgtcaatgcactggggcaagtactcttccaccttataaacgggtactataacggatatttccgggacatgattcatattcgctcattttgtatgcaacattgccttcatttttatagacaacaccaacaaatagtaggctgactttacaaaagccttaaaatacagatagccggcatacgtaggaagcacataatggatgttctgcaacatcagcttccattcgggacgcaggcccgtcatctccaacaaagacgcatactttttgttcctgaataccaaataactctgataatgaaaggatgtgtctttcgtgaaatacagaatacggtcaaaatattttgccttcagagtctcaaaaaaaatatatatatcccggttatcctgcaaacaccgagaagaccggataaaatcgtagatataacccagcaccagcacacgacattccaaattacgcatagacggcgcccgcatgatggagtctggctgcatagaataatagtaagtggtctcaccgacgacatacatactttgagccatacatgccaacttaaatgaccataaatcatcctcgtgtacaattccctcctggaagtagagtttatgctgcaaaacgaggggacgactcaccagtttgttccatgccatgacataccattttccctgcacataagtggaaagtacaagagcattcccttcataaaacccggtgcctaatgataaaggaggagcccaacgtctggcaccggtcacctcgtaattgcctatcacaaaatccggtcgcttctgcaccgctgcatctgccaaaagctctattgcattcgcagaaatatagtcgtcgctatccaagaagtacagataatcgccaacagacgctaaaataccggtgtttcttgcagcagaaagccctctgttctcttcatgttccagacatctcaccaccgctccgcgcggatgcgaagccaccacccgtctgactatctccatagagttatccggagtgcagtcattcacaagaataacttccaaatccggccaggtctggttcaacacagacagcagacaccgttctatgtacttggcaacattataaaccggaacaataatggaaactttcatactttcaatcatattttcagaatttcacctcatggccttccacaaactcttcccaccacacaacaagcgtcaacagattgaaatattgcaaagccttgttctgcctatgccagaaccaaccgccctccttctctgcaacttgttcataatctgtaagaaacttcttcactgcatcacgacgcagatagttgtccataatgccggaagcaagaatgaattccttaaagagagcacgtcgggccctatcacggaagaacagtggcataggtgcaaaaccgccctgcttcttcttcaaggtaatggcctcgggaagtaaaggtttataatggtgctttaacagatatttagaaacggaacgaccccgcgcaatgtccagtacactgctgcccctgcacttcaaccctaccggtagctcctgcaggaaatggaaaagctccaggtccataaaaggatacgtcagattgttaccgaacatgcgtgccatgctggaagccttgaaaagaatgatacggttgattacagtctccaaatcggaaagaatggcatgctgcgcgtaaagatgctcgaaactatggatatcaggccgtagtgattttaccggctcaaaatcttcttccggattttgcagaagggcacacaaggcagagtcggaaaagccgaaacgctccccttccagaatatgaagtatcttatccaaatggaaattgatgcgggaaagctctccgccggtatcaaaggtttcatgctccagcagacggctgatgccacgcagcaagggacgcaatcctatgcgggcggctagataatgcaacgccacttcgcgaccggaagtaccgaaatactggtcactgccgtcacctcccagaatcacgtcgggcttgtcatcgcctatcatgcgcatggcacaatagtttaccatcagcccgccttccataaaaggctcacccagaaaacggacaatgtcgggcaaggcactggtttccgtaccgtcaatctcgtactcatgatggcgcgtgccgaaggtttcggacatcagacgggccatgggcagctccgtccaggcatctcctttaaagcccacggaataggagtcaatctggccgtcgtaaatgctgcgcagcgcagcaaggttggacccggaatcatagccgccactcagcaggatgcctaccttgcggctgtctccgatacgccgacggatggcttgcgcatgcaattctccataacggcgggaataggcctcgacatccggattccgttcagtcgccaccttgggttcatgctcaaaaacgctgtcgcgcttcagacaataaatgtcatctgccaccttctcatataagccgggatttctttccttcagcgaatcaaacatggaatgtacgttcgcttgtgtctctaactttacagaagcccaaaccggcatcagataaccaagctctgtcaacatgtagaacttttcgccggcacctaaagaatgaacatcgaatagggcgaaattattcttcttcaaaatgccacgctgaaggaatgtactcaatgaaaccagattaggctcgaaattttcttccagttggtcctctaaaaattgccaggaagtggcaaaattaccatcaatgtgacaatagacgggataatgcgtgccatgatggtcgcgcaccactccgcattcattttctgaataatatactatggtgaacgaaccgtccagacgtgaaaagccatatgccggatcggatagaaacgcatcggcagcaagcttggcattggtatcatccggagttgcctgcaaggtgtcccgattatacaaagttccgaaaaagaaaagtctcagattataactttcaaaagaagattccggctcttctccctctacacaggctgtacgccaatcttctaaagtgatttttccgtatatcatttgtttgcttatagacttgtttattgtgtatccctttctattccaccaccccatgcctggtatgtataaaggtcttgtttgctcccctcagcttgaagatgtttcctgccatcagcaggaatgtatagggtatcttttgcagggccattgccaggcggctggtgcagaaccttttgggaacggcaacgagcagtgcgacagcgagcaacaccaagagcagccaccacttcagcccccatgtccagcgataaaccgtgaacaacacggagaagaggaacgtgaagcccaccaacagcaggcgaggaatggaaagctgctggaaaagcttgtcgcagaagtcccaattacgcgcaacaagcgccttccacagaaacttggcgaaagtctggcagtagtgccattgtgccgacagccagcggcggcgctgacgggagaaatcaccggtgttctgtatcttctcatcaaatacaaaggtttcgggcagataataaaagcgcttgccgcgatagagcagggtcagctccaattcacggtcgaaaccgcctacagccttgatgtcagccatcgtatcacggaacaagtcataacggaacgccatgccggaaccgataagggcggccgacaagcccagcttggcatgccccaaacggaaaatggtgttattgatttcctcactgatggcatcgagcaaggccatgtcattgttcaggttctttgcactccggtgggtctgcacaatctcgacttccggattggcgaagaggtcgttaatatcactcagataatcgtaagggatgacattgtccgcatcgagcaccagagcgatgtcataatcattaccgatggcagtcatggcggcattcagagatttggacttggtgcttttctcaaaatgcacttcaaccaagcggacaggaagcatagcgagggaagcgttggtttcgggctgcatacggtccgaaatgacaaccgtatcaaaacagtcggcgggataatcctgctccagacatgaatgaacgcactcgtgtatcacggcatcttcgcggtaggcaggaatcaatatggcaaaacgtttgtgttccttggctggagggggtagaggcaggtcacgtcggcgtgacgccagactgtaaaccaatagatacagtatgtttattgcaaacaatatgtacaaaagccaatcaagtatattcaatatatgttccaaattcagggctatttaagctttagagctgctgcttgtttttaatgggtatccgacacaaagatacaaaaaagaagtagagtttggataaaatatacaaaaaatgcgaagaatataggaataaaaaaacgagcaagctctcacgaacccctcgcccctataagaaaagcctttaaggcttttcttttaaactacatcaatgttacctaaaaatcaatctttctctttacctaaaaaaataaaacttcaattacctattctgaaaacttcaaaatccaattttacctttacctaatttacctatttattcaaaacatttagcttatgaaaaaaatctattttcaatccttttacctaataactaatatcctttattgaaaactgttttattatttatcaaatccaaatgcagtttcccaactgcactgcaaaggtaagtgttttatccgcgcgcacaaaatgccgacacatttttcgcgcgttttataacattgttttagagtttaagggtatagtttacacttataaacaatttgttgttcatcgggagcatactttccagtaaaaaacaagccaccgaaacgccgaaacgcttcgatgactgtcccctttaaacacctttaaacaaaatgaatttcttatttatttcctcgcttcagcaatatagcccaaagcttctttacatttttccgtaacataagtccagtcttcagcagcgaccttatccttcgggaagagtttggaacccatacctacgcagaacacacccgccttaatccaagaggtcaggttttcctgggtcggctccactccaccggtcaccatcagcttggaccaaggcatcggagccagcaaacctttcacaagtttggcaccaagcacatcgcccgggaatatcttgcagagatcgcaacctgcttcttgcgcgaagcctacttctgaaacgctgccgcaccccggagtataagctaccagacgacggttacaaatcttagcaatctccgggttgaacaacgggcctacaacgaaacatgcccccaactgcaaatacagcgccgcagtagcagggtcgacgatggaacctacacccatagccatctccgggcactcttttgccgcaaacttcacaacttccgcaaacacctcgtgggcaaagtcaccacggttcgtgaactcgaacgcacgaacacctccatcgtaacaagcctttactactttctttgcaacttctgcatccttatgataaaagacgggcaccattccagtagaaccaatcttattcaatactgcgattttatcaaatttactcatctttttatttacgatttgacgatttacgatttacgattaatattactttactttatatctattctttttatttacgatttgacgattcaaacttcctttgctaaccgatttcttgtagtgacaatagaactcactattattttatacaattcatgcgcctcttgttgcaacccaagcagtttattagcaggaatcatctcactttcagcaataattttcaaccagtgtatagtttcatccagttcttcctctaccattttcagtttattcagaaaatccttatcagactttcccaaacaagctgccctataattggcagcaggtgaagtccctgaacgtactatttgtttagctatagccattgacgaaatccgattaggcatacaatctaccatcttgattattctcaaagagaacaccttcaatcgtattttcaattcctccgagttcactgtagaagtaatttcaatcgtacatcgtaaatcgtcaaatcgtaaatgagcttagcgttgtactcgtccgcttgcatcccctcctgccagcgcttctacctcttctgtagaaacgaggttgaagtcaccgttgatagtatgcttcaaggcagaagccgctactgcaaattcgagggcggcaccctggttaggttttgtcagcaggccgtggatgatgccgcctgagaaagagtcgccaccacctacgcggtcgatgataggattgatgtcgtaacgctttgattcgtagaattcctcaccgttgtaaatcattgccttccagccgttgtgggtggcagagaaagactcgcgcaacgtagagatgacatatttgaagccgaattccttcgccatcgccttgaagattcccttgtagccttcagcgtccgtcttgccgccttccacgtctgcatcgggcttgaagcccagacagagttcagcatcctcttcattgccgatgcagacatccacatactgcatcaaaggcttcatgatggactgggctttttctttggtccagagttttttacggaaattgaggtctaccgacaccataacgccgtgacgcttggcagcttcgcaagccaagcgagtcagttccgcagccttgtcggagatggcgggagtgatacctgaccaatggaaccagtctgcaccttccatgatggcatcgaaatcaaagtctgccgcatctgcctcggcaatggcagagtgtgcacggtcatagattaccttactgggacgcatggaagcaccagtttcaagatagtagatacctacacgatcaccaccacgcgcaatgaaatctgtctttacgccatacttgcgcaatgcgttgacagccgactggcctatttcatgtttcggcaacttggttacaaaataagcatcatgcccgtagttggcacagctgacagctacgttggcctcaccaccgccatataccacatcaaaagagtcggactgcacaaaacgggtatttcccggagtagacagtctcagcattatttcacctaatgtaactactttctttcccataatctttctatattttattttaatatgaaattaatttatttcctttcaatttatcatcacgaggtataaaaagaacttaaacacttgaaaatatgaatagtaaatcaaaacaacattcattcctcacagtcttcgtgtgcgggcacaaagatacaacaatttttgaaatacaaaaaattatcatatatttgtagcggaaatatcaagattattattgtgcacgagcacaagacatatactctacttggtacattgtaaattataaatatagatggaaagagtcagaataaaagatattgccaagatggcagacgtatcagtgggaaccgtcgaccgtgtgattcacggacgcagcggtgtgtccgaatccagccggaaacgggtggaagaaatcctgaaacagctggattaccaaccaaatatgtatgccagtgcactggcttcgaacaagaagtacacatttgcctgcctactgccactgcacgagaaaggcgaatactggacagacgtagagacaggcatacacaacgccgtagagacttattctgactttaacgtcgccgtgcacctctcctactatgacccgtatgactatcattcattcgcggaagcctccagacagattctgtcactggagccggacggagtgatgtttgcccccaccgttccgcaatacaccaagccctttacggatgagttgacgcaacataatataccttatatatatatagactccaatataaaggaagagcccgccctatccttctacgggcagaactcgcaccaaagcggatattttgccgcccgcatgctgatgctgcttgccggagaagacgcgcaggaaatcgtcatcttccgcaaaataaacgaaggcatcgttgggtcgaaccagcaggaacgccgcgaaataggtttccgcgaatacatgcagaagcatcatcccgcctgccgcatctgggaactggacctgcatgccaagcgcgacagcgaggacacactgatgctagacgagttcttccaagagcatcctaccgtaaagaacggaatcaccttcaactccaaagcatacatcatcggggaatacctgctgaagaagcagaaaaaaaacttcaacctgatgggctatgacctgctgcaacgcaatgtagactgtctgaaacaaggaagcatcttcttcctcatagcacaacagcccaccctgcaaggattcgacggcatcaaggccttgtgcgaatacctgattctgaagaaggaaatcacaagggaaaacttcatgccaattgacttactaacgaaggagaatatagagttttattacaataaatagttgcatgtacaatgtaccatctacaatgtacaattcgggcatgcggaaggggactaatactagtgcagcgcagccaaattgtacattgtagatggtaaatggggaatttaaaaaatggaggcaaagtacctgaaaatcaatccttccgacaatgttgcagtggctatcacagcacttccggctggtgaaaaactcacggtggacggaaaggaaatcaccttgaatgaggatgttcctgccggacacaaatttgcactgaaagactttgaggaaggcgaaaacgtcattaaatacggataccccatcggccatgcccggaaagcgcagaagcagggagactggatgaatgaaaacaatatcaagaccaacttgtccgggttgctggaatacacatacaaccccgtcaatgtagacctcaatactacggtcctaaacctcaatactggcgcgccaaacctgacctttagagggtacaaacgcaaaaacggagatgtaggcgtgcgcaatgagatatggattattccgacagtgggctgtgtaaacggaatcatcaaccaacttgccgaaggcctgcgccgcgaaacgggcggaaagggcgtggatgctatcatggcttatccccataattacggctgctcccagttgggtgacgaccacgagaatacaaagaaaatcctccgcgacatggtgctgcatcccaatgcgggagccgtactcgtggtaggcctgggatgtgagaataaccagccagatgtattctgcgagtttctgggagactatgaccgggatcgcgtaaagtttatggtgacccagaaagtgggtgatgaatacgaagaaggcatggagctgctgcgcgaactttatgccaaagtcatccaggaccagcgcgaggatattcccttaagtgaattgcgcgtaggcttgaagtgtggcggttcggacggtttctccggcatcaccgccaatccgctactgggcatgttctccgacttcctggtagcacaaggcggcaccagcgtactgacggaagtaccggaaatgttcggtgcagaaaccattctgatgaaccgctgccgcaccaaagagttgtttgaggacacggtgaagctgattaatgacttcaaggaatatttcctctcacacggtgaaccggtaggcgaaaacccgtctccgggaaataaggcaggtggcatctctacattggaggacaaggccttgggatgcacccagaaatgcggcacaagctacgtggaaggggtacttccatatggcgaacgcctgaaagtaaagggactgaacctgctgtctgctccgggaaacgaccttgtagccgccactgcccttgcctcttgcggatgccacatggtgctgttcaccacaggacgcggaacgcccttcggaacctatgtgccgaccatgaagatttccaccaactccactttagcaaagaacaaaccgggctggatagacttcaacgccggagttatcgtcgagaacgaaccgatgaagcaaacctgcgaacgcttcatcgagtatatcatcaaagtagcaagcggtgaattcgtgaacaacgaaaagaaaggctacaaggaaatagccatcttcaagaccggagtaactttgtaaattgaaaattaaagactgatagatggagggcgggacaaaaccattttgtgccgccctttgtttttgttacctttgcggcggaattgatttcaccacagattaccccgattaacatggaattgattgaaaggtagaaatctgtggtgaaccattaatctcaaccaaacaatacaactatgtcagcaacaaccgatacaacccctaaaacccaaagcggctggtgggcactcagcccgttggcggtgttcctttgcctctatctggtgacttcgctcctggtgaacgacttctataaagtccccatcacggtagccttcctcgcctcgtcctgctatgccatcgccatcacgcgcggcttgaatctggaacagcgcatctaccagttttccgtgggcgccagtaacaagaacatcatgctgatggtatggatattcatccttgcaggagcattcgcccaaagcgccaagcagatgggcgccattgatgcgaccgtaaatctgaccctgcatatactgccggacaacctgctgctggcgggcatcttcatcgccgcctgcttcatctccctctcgataggaacaagcgtaggaactatcgtcgcactgactcccgtagccgtggggctggcggaaaagacgggcatcgacctgccctacatggttgccatcgtggtgggaggctcgttcttcggagacaatctttccttcatatccgacaccaccattgcatcgaccaagacgcaggactgcgtgatgagggacaagttccgcgtcaactttatgattgtggtaccggcagcacttatcatactgggcatctatatctttcaaggactgtccgtctctgccccaccacaagtacagaccatcgagtggataaaggtaatcccctacctcatcgtactgggtacggccgtagcaggcgtcaacgtcatgctggtactgctgctgggcatcctctctaccggaattatcggtgtctataccggcaccgccttcttcgactggttcggagccatgggaacgggcatcaccggcatgggcgagctcatcatcatcaccctgctggccggaggcatgctcgaaaccatccgctacaacggcggcatcgacttcatcatctcccggctgacccgccacgtcagcggcaagcggggagccgaattcagcatcgccgccctggtcagcatcgccaatctctgcaccgccaacaacaccattgccatcatcaccaccggccccatagccaaggacatcgccatccgcttccacctggaccgccggaaaacagccagcatactggacaccttctcatgccttgtgcaaggtatcatcccctacggagcacaaatgctgatagccgccggacttgccggcatctcccccatcagcatcatcggaaacctatactaccccttctgcatgggagcctgcgccatactcgccattctcctgagataccccaggaaatactcgggagaaggatgagtgataagtgatgagtgatgagtggtgttgtgtgaacatttaaaaaaaacaccctcatgccaacaaataactcataactcataactcataactcaaaatcttttcttacctttgcacccgctattacgagatagtagcataattcaaatcattaactaaaaatattttaattaaatggcaacaaaaatcagattgcaaagacatggacgtaagagctacgctttttactctatcgttattgcagacgtaagagcaccacgtgatggtaaatttattgagaagattggtacttacaatcctaacaccaatcctgccacagtagatttgaagttcgaccgcgcacttgactgggtgttgaagggtgcacaacctactgacacagttcgtaacatcctctctcgcgaaggtgtttacatgaagaagcacttgctgggcggtgtagcaaaaggcgcatttggcgaagcggaagctgacgctaagttcgaagcttggaagaacaacaaacaaagcggtttggctgctctgaaggctaaggaagacgaagctaagaaagctgaagcaaaggcacgtctggaagcagaaaagaaagtaaacgaagaaaaagcaaaagcattggcagaaaagaaagctgctgaagctgccgcaaaagctgctgctgaagcatcggctgaagaggctcctgcagaagaaacccctgctgctgaagaaactgctgccgaataatagtaagcacagcattatcgctaaaaatgggattaaaactataaaaatcctctccggttcatatcggaggggattttttattactatatttgcagctataatcattcattaaaaaaacaagcaatgaaaaagtttacttatctgctcgctgtagccgctgtgtttacggcttgtaacagtggaaacaacggttacaccgtaaccggaactgtagagggtgcagccgacggcgacaccgtatatctggaaaccgtggaaggacgccaattcgtcaaattggattctgctgtcatcaaaggtggaacatttaccttcaagggcacacaagatactgctgtcaaccgctacatctcttacaaagccgaaggaaaagacggcgcagccatcgacttcttcctggaaaacggcaagattataatcaacttgtcgcaggaaaacaactctgccaccggtactgccaacaatgatgcctaccaggaaatcagagcccaaatcaacggtctgaacaaacagatgatgagcatctacgaatccatgtcggacaccacactgaccgacgaacagcgtgaaaccaaaggcaaagagatggaaaatctggaaaacagcatgatatctgccatcaaagccggcatcaaaaagaacatcaccaacccggtgggtgtactcctgctgaagcagaactattactacatggatgtggcagacctcaacccgctgatgccccaaatccccgcagcttacgacaacgacgaagccatcgtcaagataaagaacaacgttgagaaaatgaaagccactgccgtaggccagaagttcacagacttcgagatgcagacgccggaaggaaaaacggtaaaactatccgactacgtaggcaagggcaaagttgtccttgttgacttctgggcaagctggtgcggcccctgccgtcgcgagatgcccaacctggtggaagcttacgccaaatacaagaacaagaacttcgagattgtaggcgtatccctggaccagagtgctgacgcatggaaagaagccatcaagaagctgaacatcacttggccgcaaatgtccgacctgaaatactggaactgcgaaggcgcacagctttatgccgtaagcagcatcccccacactgtgttgattgacggtgaaggaactatccttgcacgcggattgcacggtgacgaacttcaggaaaagatagctgaagctgttaaataataaagccggacacaccggaagctaaagaagaatgccacacttcgcaaaggcaaatgctattgattgcgccttgcgaagtgtggcatttcaattgataaaatgtggcatttcggtcaatgaagtgcggcattcgggatgatgaagtgcggcattttcaagagaagatgcgtgccgccatttccatacccaaccgtacggtttcccactgcttttcctcatcggcctccgaaggggaaagaagcgcattcgcatccggcaggcacaaagtgaaacgtttcaaggggatatagttcaacacgctctcggtcttcgcctgcaattcatccagttcgtcttcctggggataatgggacagcacgaaaccgaataccgcctctttctcgtgtataaaccagagcagacggttgcggtcgcacgcgccacagtcgtaattcaagaaataggcatcggccccatgcagctgcaccaacatatccgtaggtgcatggaatgcaacatacatccctgcaggacgctcgcgcaaaacacggttattcagccgaacggtatcttccattatcaccgaatgcaccccgtcgaactggacgtagcgacaaccggcatcatagagttgggtaagcaaaagtttgtagcaggaagcaatatcatccgtcaaaagccgaatgtcggaataaacggtttctatctgagtccgctccacgcgttgaataatctgggtcaagagttctgccggcgaggggatatgctgtttcttcatcacctccccacccgcaatggaatcaagaaatgcaaattcttccagaaccggatgccggagcaagccgagccgttccgtaacctccaaaggagaaccttcggagaaaaactggccgtctttggaacggataccctcccagctttccaaaaaatcacgacttcggaaaccaccgtcggaaaccaccttcatgcctccctgttccagccgttccacaagattgcgcactgacgcatcttcaaccgcctgcaaagcctgccggctcacttgtccgttctgatattgctcgcgggcatccttcaatgcacgaggtacgcaaaaagctccagcgatgtctattttaaacggaggaaatacatttgccatattcatcctttctttgattattaaaataatgatacttcagcccctatgccacgggcaataaagcaatacaattgaacggtaacaagagacattatcaaggattgagaaccttaaataaaccaattcgttacaaatataactaaagaatccgaaaatccacaatccgctccaaagatttatcttcatttgacacttgaaaattcagagaatgctcaagtatacaacaacagcctataacgaacaactttaaaaagtaatttttattcaaagttttctatttacaaataaaacaccactaattatcaaacgattaacactttttaaatcacaaaaagtttcccaaaaagtaaaacctatcaataactataatacctttgtttccgcatttaaactaaatagatagtcacatttaagtataaaaggttatgatacagacagtactcaagcgcgacggacgcgtcgtcggattcaacgaagaaaaaatagccaccgccatccggaaagccatgttgcatacagataaaggtgaagacctgcaactgatacaccagattacggaccgcatctctttcaagggggattcgcagatgacggtggaagccatccaggatttggtggaagtggagctgatgaagagcagccgcaaggacgttgcccaaaaatacatcgcctaccgcaaccagcgaagcattgcccgcaaggcaaagacgcgcgacatgttcctggagattatcaacatcaagtccaacgacatcacacgcgaaaatgccaatatgaatgctgataccccggcaggcatgatgatgaaatttgccagcgaaaccaccaagcctttcgtggacgactatctgctgagtgaagaagttctggatgccgtcacccagaactatctgcacatccatgacaaggattattatcccaccaagagcctgacatgcgtgcaacatccgctggaccatattctgaaatacggcttctctgccggacacggcgaatcgcgcccggccaaacgcatcgagactgccagtatcctgggatgcatctcgctggaaacagcccagaacgagatgcacggcggacaagccatccctgcattcgatttctaccttgccccctacgtgcgcaacagcttcatcgaggaagtcaagaacctggaagaactgaatggaaaagactattcacacctctatcagaaggaactggccgactatctgctacagccgttggacggactgacggacgaggaccgcatcgtgcagcatgctgtcaacaagaccgtatcgcgcgtgcaccagtccatggaggcgtttatccataacatgaacaccatccactcacgcggcggcaaccaagtggtgttcagctccatcaactacggcacagacacctctgccgaggggcgctgcatcatccgcgagctgctgaaaagcacctatcagggggtaggaaacggagaaaccgccatcttccccatccagatatggaaaaagaaacggggtgtgagctacctgcctgaagaccgcaactacgacctctaccaactggcctgcaaggtgacggcacggcgtttcttcccgaacttcctgaacctggacgccaccttcaaccaaagcgaggactggaaagccgatgacccgaaacgctaccagcatgaagttgctaccatgggatgccgtacccgtgtattcgaaaaccgtttcggaccgaagacctccatcggacgcggcaacatctctttctctaccatcaacatcgtccgtctgggcattgagtgcatgaacatcgaagacaaggaacagcgcatcgcccggttctttgccaagctggatagtatgctcgaagtgaccgcacgccagctgcacgagcgcatggagtttcaaaagaccgccttcgccaagcagttcccgctactgatgtctgccttgtggataggcagcgagaagctgaaaccgaacgatacgattgcttccgtcatcaaccagggaacactgggaatcggtttcatcggattggcagaatgtctcgtggcattgctcggaaaacatcacggcgaatctggcgaagcccaggagttgggactgaaaatcgtgacctatatgcgcgaccgtgccaaccagttctcggagcaataccagcacaactacagcgtgcttgccactcctgccgaagggctgtcgggcaagttcacccgcatcgaccgtaagaagttcggcacgctgccgggcattacggaccgtgactactacaccaactccaaccacgtgcccgtatactacaaatgcagcgcccgccacaaagcggaagtggaggctccttatcatgagctgacccgcggcggacacatcttctatgtggagatagacggtgacgccacccacaatccggaagtcattatgcgtgtagtggacatgatggaccaatacaacatcggctacggttcggtaaaccacaaccgtaaccgctgtctggagtgcggccacgaaaactccaccccaaacctggaagaatgcccgaagtgcggcagcaagcatatcgacaagctgcaacgcatcaccggctacctggtggggacaaccgaccgctggaacaatgccaagctggcagagttgaacgacagggtcgttcataattaaaaattaaagggctgcgcagtgcaaagcggagcttcatttttaatggttgacgtttaatttttaatgattaatgttcagctttctacctgcgatgtttaatttttaatttttaattccctactcatgctttctattctcgacattttagaagataccacagtagacggtccgggcttccggactgccatttatgctgccggatgccccaacggttgtcccggttgccacaatccggagtcgtgggacatcaaccgcgggcactggatgagtacggaagagattctggaaaaagtccttgccgacaactttgcagacgtcaccttcagtggtggagacccgatgttccagccggaaggattcacccaactggcgcatgccatcaaggagcggagccggaaaaacatctggtgctatacgggctatactttcgaaaagctactgcgcaacccgcgccaagcccaactgctgaagtacatcgacgtactggtggacggcaaattcaagaaagaactgagggatgaggaactctatttccggggaagccgcaaccagcgtctgattgacgtacagacatccctgcaaaagggggaaaccgtaatttaccactataatccccaaaagggcatttaaaaaagtatcccgtcattcttcgcttcgctccgaatgacgggatacctacatcaccattctataaatttccctctttccctgcgcttctgcagctcctcctgaagaaagcgctgcctatccttggcgatataccggcgggcaaaaatattgggcaccgctacccccagcgctatgcagagaataatcagtgaagccgtgatgccgttggaaacaaccgccgtcacctcgcctaccacaccgtgcatattgataagcccgaaaagcgaacgatacatcaacactcccggaatcatcgggatgacggaaggaatcgtcaagacgtgattgggaacatggaaccaatgcactgccttcacggctatcaggctgacaaccatgctgcccatgaacgaacctatcaccggtccgtaacccagctcgaaattgacaaagttacgcgtacaaacggcgatgataccgcccaccgcaacaacccacaacaagcgccgctgtatattgaatatcatggaaaatcccatggcagctatcgccgccgcaatggcatacaccagataactatcatgaggcaccatactcaattcgctaaacttcttgtcaatcacaacatcctccaccgtcagcagacgcatggctatcacaatgccgaaggccattgcacagaccatcagcaccgtattcacagcccggacaatgcccacctggatataattatcaatcatatcatccacaaagtttatcaacggcacacccggaacaatgaacagtgcacacgccaacaacggatgatagggagtttccgagagtccggcaaaagaagacacataggccaagcaggtcgaaatcaatgcggcaatggcaatactcatatagtgattgatgccgaactccatacaacggacacggacgcgaaaaccggcaaaagcgcagatggaggtaaacagaaacgccatccagtcaccaccgaacagcttgcagaaacctccgcaggcaaagccagcaccgatggcaacaacgtatggcacataattccgcttcttgtttttgattctttctagttcctcctcatactggtcgagggagtagtcattctcaatggcccgccaggacagtttgctgatttcggaaatggccgtcatgttgatgccatgcttctcgcacttctggaatttggagaacgaatgcaggccgtcgctcacattcaccaccagcatggtataacttacgtcgatgtggagcttttcttccggcagccccagataggcggcaacacggttcaggttacgaacaacacggtttgtatcagccgcactctccaccagcagctgtccggtacgaagcaataaatcgagtttcctgcgcagcagggcaatctcttgttcagtcaaagtcttatccatgaatctttttacctattttttttggaggcacaaagataggcaaaatgtagaaaacgatttcattctttcggcagaaaactctacctttgcagccgtttttttaatggacacaaatggaaatattctggaatactatcgcacaatacaacgaggccacctggtggacacagctcctcatcaccgcagcaggtatcctgctcaccacgcagctctaccggaaaccgaccttatgggcaaaacgctccatgaaaatctacatggtatttctgaacgggtggatatccgtcgtgtactacatgatgtattgcggagcgcgcggacaccactatatactcgccatcttctggggagtgattgcactattgtggctatgggatttgtttaccgactacactccgttcgagcgcaacccgaaatacaaagtactggtgggggtactctatgcaatgcctttcctctacccgctcctttcgtgggcacgcggaatggaatttcccatgatgaccaccaccgtgatgccctgctcggtagcagttttcaccatcgggctactgctggctttctcgcgcagggtcaacctgctcgtcattctgttcctttgccactgggcgctcatcgccttttccaaagtctacatctacaagattcccgaagacctcctgctggcaagcgccaccgtacctgccatctatctgttcttcaagaactactttgaacagaacttacacaaggaaaccaagctgggcgcacggctcatgaactgtttccttatcctcatctgcatagtggtcggggtactgctcagcatgacgctgcttcatggaatgaaaggataaagaaatagagcgcttccgcgcaccaaaatcatttcttctttccttgattggccacagcctccattaatttctttatctcctcagggttacccaagaaatagtcttccgtcaagttcagctcatcatcaaactcaaaaacatagggcaccgccgtaggcaggttcagatgcacgatttcatcgtccgaaatatgcttcagatgtttgataataccccgcaggctattgccatgagccactaccagcaattcgtcggccgtcttcagattcgggaagatgatacacttccagtaaggcatgatacgctcaatcgtatctttcaacgactccgtacggggcagttcggcatcgggcacttcttgataacggtcctcaaaacgcggattacgtgggtcatcctcggccaatgcatgcggagccacatcaaagctacggcgccataccagcacctgcttgtcaccgtacttggcagccgtctccgccttgttcaatccttgcaactggccatagtgtttctcattcaacctccacgatttctccaccggaatccagtcctggtcgaggcggtccagcacacaatccagtgtcttcacggcacgcttcagataggaagtatacgccttcttgaagcgaaatcccttttctgccagcagctcacccgcccttacagcttcagcaacgcctttctctgtcaaatcaacatccgtccaccccgtgaagcggttttccttattccatgcactctcgccgtggcgaagcaaaacaatctttttcatatagtctcctttcagttttacctatagaacacccggctacctcctcttgttcatgcaatagcggaccacatataccaaaagtatcagaaacgccacccacaccatgctgatgaccggcaggtagcggttatacaaatattccccttccttcgggacacggttgaaagtacagattatgcaattacagcacgcatcgagtgcatcatgcgagaataccgaaaaaacaatgatagccacccccgcaagaagcatcatcaaagtcccccacaccagccacttaccagccacggaaggatggaattgcgaatgagtggaatgtacgaatctaaccataagcgcttgtctattattaccggtacaaatgtccttcatttttaacaatccggcaatacttacttttcatcaaaaagagagtctaccatcccaattagtaggtaaccgcaacctctatagaccacgcaacaagctaacacgaaatggggagtggcacaacacccaaagccctacatgtaggtatttcacgttctccggcaaagcctttactttgcagcaaacaatttaatcactttatttacaatgaaaaagactggtgttttttatggttccagtaccggaacctgcgaagagttggctaaccagatagccgaaaagttgggagtttcctccaccgacgtacatagtgttgacaagatgaccgccgataaaatcaaggagtatgaagtgctggttctaggtacctccacttggggagacggcgaactgcaggacgactggtatgacggcgtaaaggtactgaagagcaccgacctttccatgaagctcgtagccctattcggttgcggcgactccgaatcctactgcgacacattctgcgacggcatcggagtactctacgaggacttgaaggatagcgggtgtaccttcttgggcaacaaagtcagcacggacgggtattccttctcctcttccatcgccgtggtagacgatgcattcgtaggacttcccctcgacgaagtgaacgagagtgacaaaaccgccgaacgcattgacgcctggacagccgaaataaaaagcaagctctagaaaagaaacagaccatccgtttaaagtaaacggatggtctgcctgcatcatgcagatgatatctttcatctgaacagacaatgtgttctgccatatcgcaaacacattatctgttttttatgctcttatacgaaccagcgaacgtagcagaagtcttgacggtgaggcaggtctgcattcttcgggaacatacggtaagaaaccttgaagctacccgcattttccatcttgtgcttagcttggaaagtataaaggttaccttctttcttcactacattgaacggttctacggagtaaacgtgctgtttgccatcctgagccgtataagtagtcaccagttccagaccgatagcatcgttcaagcccttctcgtcgataacgtaagtaatggtgtattccttaccgctctcgatggagcctttcaccaggtcttcagtcttttcgcaagacaccacttcaatgctgtcccatttttcggcaacttcttccttccaggcagctatttccttagccttggcataaccgtcggcagccagcatcttgaaacgtttggcttccttgatgtagaacttatcgtaatagtcatccaactggcgcttcattgtatagtggggagcaatctgtgcgatggagttcttgatagtcttcacccaaccttccgaatatcccttcttgttacgtgcatagaacaacggcagaatttcctgctcaagaatgctgtagatagtagcggcatcgagttggtcctgatgttcctgattctggtaagtacgcttttcggtcaatgcccaaccggcaccttcgcgatagccctccagccaccagccgtcgagtacggagaagtttacaacaccgttcatcaacgccttctcgccggaagtaccggatgcttcgagcggacgtgtcggagtgttcagccagatatccacacctgaaacgaggcgacgtgccaactgcatatcataattttccaggaagataatcttacccaggaactccggacggcgggaaatctcgatgattctcttaatcaagccctgacctgcaccatcgtgcgggtgagccttgccagtgaaaaggaactgtaccggatagtcagggttattcacgatcttggacagacgatcgaggtcggtgaacagtaagtgtgcacgcttgtaggtggcgaaacggcgtccgaaacctatcagcagggcattcggattgattttgtccagcagggaaacgatgcgtgagggatcaccttgattcttcaaccaagtttcacggtattgcttgcggacatagtcaatcagtttgttcttcatcaccatgcgcgtcttccagatttcttcgtcggacacgttatagatagcctcccaaatcttggggttggactggtcgtagaggaagttttcatcaaaatgcgcagcatagagatgtttccactccgtagcgctccaagtggggaagtgtacaccgttggtaacgtagcccacatgactttcttcggggaagtagcccttccagatggaagcgaacatctcctgggaaaccttcccgtgcaaccagctcacaccgttcacctcttgagaagtgttgcaagcgaatacagacatacagaaacgctcgcccttgtcgcccggattgttacgtccgaggtccatcaggtcatcccagctgatacccattcttgaaggatagccgcccatgtacttgccgaaaagaccttcgtcgaagtagtcgtgaccggcaggaaccggagtatgtacagtatagagagaggaagcacgtaccaactcgatagcctggtcgtaagtcagaccttcggccacgtagtcacagatgcgctgtacgttgatcaaagcagcatgtccttcgttgcagtgataaatatctttcttgatgcccagcttcttcagcgtcagaataccgccgatacccaacaaaatctcctgcttcagacggttttcccagtcaccgccatacagttggtgagtgatggaacggtcgaactcactgttcatttcattgtctgtatcaagcagatagagggagatgcgtcctacatttactctccacacataagcatgcacgtagtaatccagataaggaacatccaccaccacttgttgtccattctcgtccaatacacgatcgatgggtaactgtccgaagttttgcgcctcgtagttggcgatctgctgaccgtccatagacaaggtttgggtaaagtaaccatagcgatacaagaaaccgactgcacacaagtcaacgttactgtcggaagcctctttcaaatagtcaccggcaagtacgcccagaccaccggaatatatcttaagtacgtggttcaaaccatactccatgctgaaataggcaacagacgggcgcttactgtcaggcgtcacatccatgtatgtacggaattttgaatatacatcttccattctgcgcagaataaccttatcgttggcaagcgcttcaagtttggcataactcatacgctccagcagaagtacggggttctgtcccacttctttccaaagggcaggttcaagatctctgaagagttcggtggcttcataattccatgaccaccaaatgttacgtgccagttcagacagtttctccagttcggcaggaatgtgcgatttcacattcacgtctttccagttaggagtgtttacattactaactttaatcttcattgtatgataactaattgattaataattcttttatcttaattgacgcttcatggcgttgcacagcgcaatatcataagcctcatagtaatactttataaaatgcttccataaggcctgctctgccacctgacctgcacgtttacggatttccttgatttcggcttctgtcttggtcgagaacaaggctacggtatcctttatgccgtctgccacttcggaataattgtaatccgaacggtgcagcacctccactccgtcgtcaatgccatgctgattcttcagactgttcacccaaagtccaaaaccggcaaggtcggtggtgatagtgggcacgcggaaagccacgctttccagcggggtatatccccatggttcgtaataagacggataaacactaagatcttcgcctaaaatcaagtcataataatgcttgttgagaataccgtcgtggccatcctgatagcagggtacaaaaatcactttcaccttatcttcgggacgattgcccataccgaggtatttcagcatatccagcacctggtcgtgcgtcatattgtgcagccagtgagtgatgaaagggcactgtaacggctcggtaaacttatccttgctcttaaggcgtttctgcaaatcctcgcgggggtctcccacccaactaggcacgttgacaaacgccaatactttctttttcaaatccttatcccggttcagcctattcaatgattccaggaacacatcaatgcccttattcttgaactcatagcgtccgctggtaccgataatcagcgtatcatcacccaagtcctcacccagcaggcagtttgccacacgcaacatggtggaacgggcacgtttgcgcttgcccgtgaaagtggcgcctttcggtacaaaatcatcttcaaaaccgttcatcagcacaacgtccgcaggcttgtcaagcaactccttgcattcgttgtttgtgatttcgctcacggtagtgaagcagtccacataatgagccgtctgcttttctatggaatgcttagactgcatattcaactcctccgccatctggtcgccgttgtaagcgaagagataatcgtagagcggcttattgttgcctgctatggaacggccgatggacgtggcatgtgtggtgaagatagtccctatctcgggaacggcagactgaagatagagggcggccataccggtcatccactcgtgtgcctggaacaccactttgtctgtttccgtcagattatagcggtagaaactctctatcacctttccggtagcgaaagcaaacatggatgcttcgtcataatcgccatatccatgcagcgaatccacttgatagcggttccacatctctgtataaatctcatttttttctgcaaagaacggttggaaatcaaccaatataacaataggttcccccggaatgttccagcgtcctacacgaacagagagattgtctttcaacgcagcatattttttccacgctgcgcaaaggttatcagactcaatgaacaaagggttctcttttccctgccagaaatccggccctataaagaataatctatcgcgaaatttagtctgtaaagtatttgcccttgtagacaaaaccgtatagataccgcctactttattacacacttcccagctcgcttcgaagatgtaatcgggggtaagtagttctttagtcatattatgttataatctctttatcttaattacggctgcaaaagtacgtattattctttgaaaaatagccttttaatcgaaaaaactgattaaatatgcataaacaatcgtttacggaatatcatagtttaaccacaaaagcctcatgggttcgcccatccctgcatttttcgtctaaacttcccgaagtttagacggagaatccctggagttttcagttgaatccccaaggatttaaacaaaaagctccagagatttcagttgtaaatccctggagcttattttcttataatccggattataccatcaatgcagctaccagcgccaaaatagcgtagaattcaggaagtgcggcgtaaatcattgtattggtctgtacgtcgtgtccttgtgagatacccacgataccgctggcacaaatctgtccctgacggatagcggagaacagacataccagcccgacacccagtccgatacccagcatcaaagggccgtccgtagcaaaatccctgcccatagacatcaggaaagccacgaagccgtaaagtccctgcgtagccggaagagccgacaaaatcatataacttgctgacttggaagggtctttcttcaaagctccttctgccgcactaccggcgattgttgtaccgaagcaactgccaattcctgcaagggccaacatcaggcccagaccgagataacctaaaatttcattcataatgtttctatttttatttgttttttaatttgtttatttctttactactgtaaaaggtttgtaggcttcgcccttgccttcgtaaccggaattcttgaagtattccacgaatgtcagacggagaggatggacgaaagcgctcaggcaagacatggcgatattcagcgtatgcccgaatatcagtatcagtccgcagaacagccagcccagggcaggtcctgccgcatcgttcaccatgaaggcaagctgattgaacacgccgccaagcataccgcctgccagaccgagggcatagagacggatgtaggaaagtatatcgcccatcagtccggttgccatattataggtgtcccataccccggcaccgatgttgacaaatacattccggtggatgttgttcagcaggtagatgccaatggcggaaacaccgccaatcacgatgaatgcccatgtagacacatcttccgaaattatcttgaagaaggaaagtccgccggtacagataaatcccactaccagcaacagccatccccaggcactgagcgactccttgaagccgaagcgcacggtctgccccactgccttcaccgtcatggcaatacagatatgtaccgcaccgataatcagcgccagcagcatttgtttgtcataggtggtctcgcctatcttgcccacaatcatgaattccttcagtttggcgggtatctccaggtcgaagaggcttacaccgaagaatgttcccagtatggcaccgatgacggccgtgaatatacccagcgtaatcaccagattcatcatgcctttcatggactcggacatcttctttttcaggatgaacccgagtgctatcagcaccaagccgtagcccgcgtctcccatacagaaggcaaagaagagcgagaagaacggcgcaagtattggcgtcgggtcgaactctgcatagtcgggcatgccgtacatttttgtaagcacttcgtacatgcgtgtataggcgttgtttttcaacttgatgggagcgttgtcctcgcgtctggccgcccttatctcataataagtgccgttttcatcgagaagtttcctcacatccgcctcgcagtcttcgggaatccagccttccatcagcactacggctccttccgccatctgctcgctgttcagcttgactttcagcaggtctatttctccttgaagctggaggttgtatttctccaacgtacagtaattcgccttgcagaagtctttcagcccggcatgtgcctgcacaagggcttcttccgtaccggctttcttccggctcagctcggagaggctgagtgaaggcagacggagcggttccacatccagctctaccggctggggagtgacggtcacaaaataaagatgtccgccgttctctttcaccacgatggcattgtagtcctctgcccacgcttcgttatagtctttctccgggcaggtgtagaactgcacgaaccagccggcatcttccagccggcggatggattcccaatcgaaatcaccccaagcctccatctgtgccacgtccttgtcaatggcgggaatctgctggttcaagtcttgtatacgtgcctgcaaatcctcataggatttcaccaaagcatcggcagacaactctttatgcaccttttcttccggctgtttgtccgccagggtgtacatgctctgaagcatattcttgtagagcgtacgcttctgcatgaatcgctgcaaggtgtcgtccatctcgccgcactgcctttccacaacgtgcaccacgcccagttcccggatctgtgccagaaacgcttcgtactccttatgatacacaaggaacgtgagcttcttcattttcgtaatcatgcctctgcctccttccttttctcctgatgggacttcatgattttctgcgatgacttggagaggttctcctcgtcttccataaaccgcttgattttgcgcagagcatcctgatagcccggaatctgtactttctcaaaaagattcaccttctgggtggtctttttacgcgcatgttccaacaaattcaacttggcaacgataaattcacgctcgatggcagtatgtgccagcgacttgagcagatgcaacccgtccgcataccatttgggcgcattgaacaagctgtagggacgtatctcgaaatctacattctcgagcaatggcacccgtacaccggcaatcttcttcacaccgagatgaacatcgctgacctttatcaatgaagcgtcgaactcattccaaagggcgaacatggcttcgtaagcttggatttccttttccaacctcgcatccagcgcggcagcatcgcccttgcaacgcttcacttccatacgcagggcactctccttgttcttgatgatggggagtgtacgcacgcgcaccttcagttgcttttccaactgctggagggaggttttgttatattgaaacttaatagccattttatttacgatttaacgatttacgattagacgactgaagctactcaatttctcaatttacagatttacaatttcagtaatatcaatcgtaaaccgtaaatcgtctaatcgtacatttatttagtttgctttcggccagaactggtccacaagctctttcttgatattcacctcttccggacggaaatacttgccgaacagactccatgccacatcgagcatctctgtggtatcgaggttgacatcgatggccagcagctggttggagtagtccttggcaaaggcaagggtacgttcgtcgtagttcgtcaggtcgaaaccgttttcaagcttggttttggcgttggcggcatcggcgtacagacgtacggcggcattcatcacctgcggatggtccttacgtgtctttttgcccgtaacaagctgcttcagacgggacaaggaacggaacgggtcaacgataaccttaccgatgtcgctgtcacgacggaggaacaactggccttccgtgatataacccgtattgtcgggcacggcatgcgtaatgtcgccaccggacagagtcgtcaccgcaataatcgtgatggaaccgccgcttgggaattgcaccgccttttcgtatattttcgccaagtccgaataaagggaacccggcatggagtccttcgaaggaatctggtccatacggttggacacgatggcgagcgcatcggcgtaggaagtcatatccgtaagcagcaccagcaccttttcattattgttcacagcgaaatactcggctgccgtcagtgccatatccggaatcagcagacgctctaccggaggattctcggtggtattcataaagctgacgatacggtcgagcgcaccggcattggagaatacgttcttgaagtagaggtagtcatcgttcgtcatacccataccaccaaggataatcttgtcagtctccgcacgcagagccacattcgccatcacctggttgaagggctggtcggggtcggcaaagaacggaatcttctgtccggacaccagcgtattgttcaggtcgatgcctgcaataccggttgcaatcagttccgaaggctgcttacggcgcaccggattcacggacggaccgccaatttccacctcctcgccttcaatggccggaccaccgtcgatggggtcgccaaaggcgttgaagaaccgtccggcaagctgctcgctcactttgattgtaggagccttgcccaagaatactacctctgcattggtgggaataccttccgtaccctcgaacacctgcaaagtcacttcgtcgccggcaatcttcaccacctgggcaagtttgccgtttacggtcgccaactcgtcataccccactccggttgccttcagcgaacacgtagctttcgtaatctgagtaatcttggtatatatcttttgaaatgcttttgttgccatctatttatttacaatttagcaatttactatttactatttaaatctctgccatcctattctactattttcctatctacaacctccgtacacctgcatccgcaaggcaaatagtaaattgtaaacagtcacatagtacatccttaggctttacgttcctcaaccagttcctgcaactgcttatggaacttctcgtattcttccgacttaaacttcgagtagttcatctgcttacagatgttaatcatcttcttgaagtaatccattacttcgttgaagttgtcgaactcaaattcggtatgacagatttctattaccatattcagaatctcctcctgacgctccatcggagtcacggcatcaacttcgtcaaaggcatcctgctgcaggataacgaagtcaatcagttccgatttccagaaagtcacgtgatattctacgggcacgccgtcgtcacccaggatgttgatttgctcggcaatctccttaccacgctgcaaacgggtcttgatttcattcaccttgccaatccaatcaccgttgatgtgcttggtgatatactcctcgaattcagggtattcaatgtatttggaatacgagtcaatcggatttacggcaggataacgcttcttgtcggcacggtcctgctcaagggcatagaagcagcgagccaccttcttcgtattctcggttaccggctccttcaggttaccgcccgcaggcgataccgtaccgataaaagtaatggaaccggactcgccgttgttcagcttcacataacccgcacggccgtagaagttggagatgatggaggacaagtccatcgggaaggcatcgggaccgggcaactcctccatacggttggacatctcgcgcaatgcctgcgcccaacgtgaggtggagtccgccatcagcagcaccttcaatcccatgctccggtagtattccgcaatcgtcattgccgtgtagacagatgcctcacgggcagccaccggcatgttcgaagtattggcgatgataatcgtacgttccatcagcttccgtcccgtatgcgggtcaaccaattcggggaattctgtaaagatttccacaacctcgttggcacgctcaccgcaggcagcgatgattacgatgtccgcttccgcctgttttgaaatggcatgctgtagtaccgtctttcctgtaccgaacggaccggggataaagcccgtaccaccttccacaatcgggttcacggtatcgattacgcgcacaccggtttccagcagtttgaaaggacgcggtttttccttatagttggtcatggcacgcttcacgggccatttctgtatcatattcacccggatgtcattgccttcgccatccgtcagcactgcaatggtatcctcaatgctgtaatcaccttcctttgcgatggatttcacggtgcacacacctttctgttcaaaaggcaccatgattttcagaggctggaagttctcgtccacttgtcccagccaggcagcggcttccacttggtcgcccacctttgccaaaggcacaaaatgccatttgcttcctttatccagcggataggtatattgcccgcgtttcaggaaaacgccatccatcttgtcgaggtcgttttgcagaccgtcgtagttcttcgaaagcataccgggccccagtgtcacttcgagcatatgtccggtaaactcggcttcggcccccactttcagtccgcgggtactctcaaatacctgcacgtagacctgggtacctactaccttaatcacctccgccatcaacttgtctcctccggtcgagatataacaaatctcattctgcgctaccggtccgtcgacgacgagggtcaccatgttggctattacgccactaacagttccttttgttgccatatatttttagttgtttattttatctgaattctgcgggtatctgcacatcgtctttcaaggcagcgataatgctgcggaacagttggttacccttctctttatccaacgaaatccaccgttctatcatctccagctgtagcaggaagacaaacagacgttccacggtaaagtaatcgaagaatgtggcctcctccatccagtcccagcgaagctggtccagcttcttttcccggtccaccagttcctccgtctcgctgattttcaccagctgctccagataatccacctcagtacccagaccgaagtcacgagcattggaagtacgcagagcctcgcacacttccgtatcacccacaatcagcggagcaatgtccagcttgaacttacgtgctgtgagcgccaccaatatattattgagagtgaggttgaaaccaaaccaggaagacacaaactgattcttacattccatggcataggcgtaatagagcgctgccaggcggtcttcatacaagaaaccgtcctcggcaggcaggctgaagtattcggaaatgaacgtggagagataagatgggaatacactgtcagagacttcgtcgccatccttcagtcgtgagatatattccgccagttcctccgacgaatagtttccgcgcgggtcgatggcagcatccttatccttcaatagtttcaagacattcgcattgtcgaatttcagataaaacaaatctatcaactttttatcatcttccgacaaggcaggatatagttccgtcctgaaatcggctactgtatagctcagtttactgtcttccagagtaagttcaggcaaaccggctaccaagtaatagtatttactcataatcctgtgggagtttttagaacagcatttccactaattgcggacgcaggaattccttgaagtaattcataaattcttcttcgccgaagttcaccttgtacgaaccatcggcaggcgatacggagaacaaggttttgatgccattcacttgctcaatcttcacacccttgtccagcaggtctttcgccttcgctgcgaaatatttcgtcaagccttccgcatccgcagtagagataacgattggttcgttcacactccatttggacgccaatgcaacgatgaaggcattaagataattcttgtttgcagcaaatgcctttacatcggcattcacaatgttgtccgtcaccaacgtagcgatttcggacttcagagcattcacagcctgaccggcaaacaactttaattcagattttgtattctctgccagttcatcggcagacttatgggcggtagccacgatagaatccgcttccttacgtgcatcctctataattctcttggcttcttcctgagcttttgcgataagtttctgtgcctcttcatttcctttctctacgccttcgcggtagatcttatcggtcagctcttgaatcttgttttccatatttgcaggagttattatatgatttatattacaatattaattgcgtgattttttcccttcctattagattcacgccaaatttacaaaaatccatttgatattgaatagaaagaaaggaagaaaagttcttgctcttccaaaaaaaactcgttttacaccaactttgttctgtaatgataacaaaagaatgacaaaagaagcagaaaatacgtctacaacaacgcatggcaaggattaaggggagcagttccggaggtatctaaaacgaacgaagcctccgtatccttatcagacacggaggcttcttctgaaaaacggatgcaaaggtaagaacttttaagtatatcctccaaatattttcggaagttttttctttttttctgtattttcaaatcctttaaacaaggataagaaaagtaaaacaagaaaaattctttttctttgcgaatcggactgcaaagataaagagaattattaataagctccaaatatttttcgaaaaatatttttatctctctttatttctctgtgtcaccttccacacttctgtctcagtatttcaatcttaccactttccttctcttggaaagcgagtgcaaaggtataggatttaacaatacaagccaaacatatctatcattttcttttaataaaaatgaaacttttttgtaacttactgattcataaaagcatttcgcatgaacaattttgaagaaaggaaaaagagagaaaataactatacattatatatatacgtgcgcgagaaaagcacaaagaaagagaataaaaacattttataagcatgccggattgggtggtggcggttctgtcagtatagtcgccgcatcaaagcagggacattgtttcacccactcttccggctctatctccccgttatggttcaggtcggggctcaggtcgcggtgaccgcaaagccgggaaccgggataatccttcagcagcagcaacacaagcacacgcagggagtgcttttggaaaagggtgcgtgtatcggcagggcgaccgcactcgtcaagaccgccttcgtagcagacaccgatgctacctgcattccacccccggacatgggcaccaggcagggacaagggacgcagggacttgatgtcaccgttcttgcggatataaaaatgataacctgcgccggagaagccccggcgcaggtggtctgtcgtcaagtcgtgctccgtatagcagcggtcgcagcgggtggcggaacaatggacgacgataagattgatgaatctcatgagaattaaaaattagaaattaaaaattaaaagtgaaggaaacccgctacactgtcatggcatgggcgctcagggcaccaataagcgcggaggctacagcgattatcactttcagaatcttatcccaaacggatgattttgtactcataaaattaaggattaatggttaagaattaatggttaaggattagtgattaaggattaatggctaatgattaatggttaatcattagggattgattagcgataaacgatttgcttgtgttcattaacccttaatcactaaccattaatcattccttttttatcccagcggattttcgccctggtcgccgtcgtcgccggagccgcctccggaaccaccgccttgattgccgccgccggagccgccctcctcgggcttgtcgagcacaaagcccacattcgccgggctacgggtcacggcggtactgccgttcaccagcttcaactccttgtcggggataaagcggatattcaccttcgagatattgcgcaccgtacatttgtccgaggcctccatgccgggacagcggaacgtcatgtggaaagtgcccagctggttcagcttcaccttgtcgccgttggcaaggttgccttgaatctcctccaccagggcttcgatgacgtgcttcacgtcgcccttcgtcatggcacagtttttctgaatggaggcggcaaggacatcgatgtccacggtgccgcaggtcttgggtttctgacggagatagtacaacatgggcgaagccgggttgcttacgattttacggcgctggaagcgctctacaattacatccataaatttgaaaagttaaggtttaagttaagaaaaatgagttataagagagaagtgggtaagggaagggatagggcgcccgaatcaatgattattccttttcttaagcacattacaaagatacaacattaagaagcggaagtcaagtgttttgccattttttttactacaaaaaacacggagacacagagtttttcaagcaataagaaaaatctccgtgtctttgtgtctctgcattctataaatttccatccatcactttgcattcctcgtcagccactccaatggtggtatgtagtccaccagttttgtcatgctttggttatggtggaaatagacttcaccggttttgccattacggtgcttggctatgatgacgatgcccaagccatcggtgggataagtactcttcttatcgacggtcttgccgtagagggcagggcggcaaagcagcattaccatatccgcatcctgctctatggcgccgctctcgcgcaggttgctcagggtggggcgatggtctatggtaccgtcgctcgcccggttcagctggctcagcagcagtacggggatatccagctccttggccagcagctttgccttgcggcttgcctgcgccacttcctgctcgcggttacggtttttctggtcactcctcatgtcacatagttgcagatagtccacaatcaccatgtcacagcgattcttgctcttcagcagacgggcggaagaacgcacgcggtccatgctcgtcatcggatggtcgtctatcagtatgggcaaccgcgacaactcggcagatgcctcatgcacctgcctcacctcgccgggggtgagctggccgctgcgcaggtgttgcgggtctaccccctccgtagctgcaagcagccagcggtcgcccaggcgctcgccttgcatttcgaggctgaagaccaccacatgacgccccgccatggcagcggcacgggccaggtggagggcaaaggccgtcttccccaccgacggacgggcagcaaggatgttcaagtcgccgcgctgccagcccgccgtaacgtggtccagagcgtcaaaacccgtagggatacccgtaatgccgttgcatccgtgctccatacgctgctccacctcggccagcgtgtcgtccatcagccggtctatggagcgaaggtggtcggctacgccgctctcgtcctccagcccctccagcagtcgatgggcttccaccaggatgtcgtcaatatccatcgactcgtcggcactgaacgccagcagttgctggaatcccgtacgcatgatacgccgcgtgtgcaattgcctaaggatgagcgcatgatactccagatgagcactggagctgaccttcgagctgatgcgtaacagttcgtaaggcccgcccacggcatcgagtttgccacgggctgccagttcgttcttcaacgtgatggtgtctatggacttcgcgctgcgatacatcgattgcagggcggcaaaaatttccagattcttctcctcgtagaacatctcgggacgcagtttgtccgccaccagaggcatggcagcgcgctctatcatgcaggcaccgatgacagcttcttcgaggtcactgtcgtgggaaaaagtagtttcagtcatcatattcattttcaaaagatttgtccgccagataggtggcggcttgtttacaatatttttggttgttcagatggtcgtaatattcgtcgatgttgtccagtgcccgctgtttctcgcctgccgtcaattttttccattcgcgacgggcccggccgatgtttaccttgggatgctcggtgatgtcatgaaacttttcccagaagatgcagaagtcctctcccgccccagccaccggcgctgccttcttcttccgcggggctgctttaggacgggcattgccggtaaggaaatcataatcggggatacggatgtgcatcacgtaggggttggccacccgctccacgataccggcgtcgaacatcttgttgaagaagtagcgcgtacggttgcggggccaccccaatatctccatccagcgggccagggaaagtacggactcgccacgtacacagtcgaaaaggtgtcccctgacgttgcaggtcaccgtgctgtagttgacgtgtgtcagcacaaagacaaaggcttcgaaggcatcggcggctttctctccggttttcatattcatttgttcctcaaacaaggctttggggaagaggagatagcctttcttcagcatctccgttgtcatgggtctcatttctttttccatttttgtctattcttaattcgataatgcgacaaaggtaagagaccagccagggggatacaaataagcagttagaatcggctaaaaattaatgaaatacataaggtggcgagagagggtttcacctcatcctccaccaccctatataataatatactaaaataatcagaatgtattagaaatacattctctatttcgcatattttttagagaccagaagatacggatttttcacggtcatatccttcacgtggtcgggcatcccccagtagctcaggaggatgcctatctgtacgggggtgaggtgggcagtcctggcggtatagccctggtccgtcaggtccttcagcaggcaagcgtgttccgcaatggaacggcgcagggcctttacggccgagcaggcatacgcgtagtttgggtaataggccactgctacatctgcaatgcgatggcatccctcgagcagccattcaaaactttgttcttttatcattttgcatatatttattaataaaacatgttgcaaagttagaatgggagggaaaactgggaaagttcgagtggcaataagaaaacttgctcaagaaaaatgaatgtgtcaaaacggttgatgacacaccctcactgtcttattgataaaagcaacactttcatactatagtagtgaagcacacattttgtgtatttcatgcaacttatcggtcagcgattttttttaagagagacagccatattatatctcgcctgcctattaacgaggagttccgcactaatccctaaggctgcttctaccataagagcgaagtcactggttacatctccctctccctcttgaagtaccccagcaccgtggccggtgtaagacagcagcgttccacgcttttcaggcggctctgaaaagtatatcgggagcatagcacaaggcagaaccaagtatagttcaagctacggtgcaagcggtgctgaaggtggtcgaaaaaacgggaaacacgggcaaagaagctagcgatacgctcgcgggggacaaaacgggaaggctgtgcggcagcattgcgggagcgcttggcggtacgttccatctgtgcaagggtatactccagttgctcgatgtcattgcgggtgttctccatggtttgttccaatttctcgcgtcgtgcctgctgcttggcatatcgttcttttctgtcagcgattcgatttttgaggtcttctgcggtgaggtttattcctttgttctggattgatttcattataaacgtctgttttatagttgtttgtctgtatataagttcacgaaaacacatcatccgtctgcaccgaatgcataatgcataaagggcaaacggatgatatatcaggagcaaatgtacgatgaatattgcagataaagttcttaatgaccattaagtcttgttataaaacatgatattatctactgcaaatttggagattatcagaaaacacgtacctttgcaatgtgtttttcatagtattagatttaaggttaacaaaagattggctgtctgggatagatagcctttttttatgcccataccattcaattcatccaattagcctcaatttcactttatacaaccttccaacccactaaagtattcttaagtccaatttgcgcgtttttttcatgcatgaccattaccgttatgaaattattttttctacatttgcatctgctaaaaggaaacaaaaccgcatcaggcagaaaaaacatgaggaatacatcacccgccgcacctaccatccgcttccgccgctggagcagaaaagcctacgctgcatttgccagcatagggcggtgtgtcaccatcggttgcctgcgcaaaaacgtggcagacagttctctctccaaacagaaagctgctggaactgccggacatgccggatgcagggaagagagtgcctggaggggtaaaacggaaggaaggaaaagcgacatcggcattccgctgggtagcagcagcgccctgacaagtatcctcacggagcttggaacgaaccgacacattctttttgaaacacaagtcatccgcccctgcggaaatacgggcggacaagacacacatagcctgaaacaaaagagaataagaggtacggattactggaagccatgcagcagaatgacgagctgcaccgccccggcaatccgtacctctgtctttatccatgaacataacccaagaaagatatgaccctacagaaattaaaggaacaagtgctgcgcggcagccacatcagtaaggaagaagccgaatggctggctgtgcaaccagacaaggaagcgctatacgaagctgcccacgagataacccgggcccgagcctcggaggagttcgacatgtgctccatcattaatgccaagtccggacgatgcccggaaaactgcaagtggtgtgcacagtcgtcgcactacaaaacccaggcagacgtgtacgacctggtgaataaagaagaatgcctgcggcatgccctgcataatgaagcccagggcgtggcacgtttctcgctggtgaccagtggacggaagccctcctccaaaaacatggagaaactgtgcgaagccgcccggcacatgcgccggcactcgtccatccagttgtgcgcatcactgggactgctcaacgaagacgaaatgcgggcactgcacgacgcaggcatcacccgctatcactgcaacctggagacagccccctcctactttccccaactgtgcagcacgcacacgcaggaagagaagctgcgtaccctgcaagccgcccgcaacgtaggcatggacatctgcagcggcggcatcatcggcatgggcgagagcatggagcaacgcatcgaattcgccttcacactgcgcgagctggaagtgcaatccatccccatcaacctcctgagccccattcccggcacaccgctggaacggcaggcaccactcagcgaggaggaaatactgaccaccatcgccctcttccgcttcatcaacccgacggctttcctccgctttgccggaggacgctcgcaactgagcaaggaggccgtgaagcaagcgctgcacatcggcatcaactccgccatcgtgggcgacctgctgacaacgctcggttcgaaagtgtcggaagacaaggtgctgataaaagatgcaggataccggttctgcggctcgcagttcgacagagagcacctatggcacccctatacctccacaaccaacccgctgccggtgtacaaggtgaagcatgccgaaggcgccaccatcaccctggaaagcggagaaacgctcgtagagggaatgtcgtcgtggtggtgtgccgtccacgggtacaaccaccctacactgaaccgggcggcagaggaacagctgggcaagatgtcgcatgtgatgttcggaggactgacacacgaccctgccattgaactgggccagttgctgctgccgcttgtcccaccgtccatgcagaagatattctatgccgactcgggctcggtggcagtggaggtggccttgaaaatggccgtgcagtactggtatggcaagggaaaggcgaagaagaataattttgtgactatccgttcgggctatcacggggatacatggaatgccatgtctgtgtgcgacccggtgacgggcatgcattcgctgttcggggcatcattgccggtgcgctatttcgtgccgcagccgcgctcgcgcttccacggcgaatgggatgaacgggatgcggcggaactgcggaaactggtagaggagcatcacgaggaactggcggcgcttatcctcgaacctgtggtgcagggcgctggcggcatgtggttctaccacccccagtacctgcgcgaagcggcacagatatgcaaggaacatggcctgctgctgatattcgatgagatagctacgggcttcggacggacgggaaaactctttgcctgggagcacgcaggtgtggaaccggacatcatgtgtataggaaaggctataacgggtggatacatgacgctgtctgccgtactgacgacgaatgaagtggcggataccatctccaaccatacgccggaggtgtttatgcacggacccacctttatggggaatccactggcctgcgccgtggcgtgcgcttcggtgaagctgctgacctcgcccgaatacgactggcaaggcaaggtaacccgcatcagccggcaactgctggaagagcttgaaccggcacgccgattgccgcaagtggcggatgtacgtgtgctgggagccatcggagtgattgagacaaaagaacccgtagacatggcgtggatgcaaaaacgcttcgttgaagagggaatctgggtacgcccgttcggaagattggtatacctgatgcctccgttcattatagagccgggacagttgaggaaactgacgggaggagtgataaagattataaaggagatgaactgagttttgaatatgccaattagcgcgtgaaaaaatttatgaatataaccgaatatatgcagcaagagctgcaaacactgaaagaacacagcaatctgcgccgcctgccgcaactgacgcacgaagggcgcacggttgtagccgatggccggcgtatgctgaacctttcgtccaacgactacctgggcctggctgccgaccgccagctgagggaagaattcctgcagacactgacaccggacaccttcctgccgacttcctcctcctcccgcctgctgacggggaacttcgggatttacgaagagctggagacggaactcgccacacttttcggcacagagacagcactggtgctcaatagcggctatcatgccaatatggggattctgcctgccgtgagcgatacacaaaccctgatactggcagacaagctggtgcatgccagcatcatcgacggcatccgcctctccaccgcacgcagcatccgtttccgccacaacgacctgctgcaactggaacgcctgctggaacaacaccatgcagcataccggcaactgattatcgtcacagaaagtatcttcagcatggacggtgaccaagccgacctcaaggcattggtgcgtttgaaaaaaagatactccaacgtactgctctatgtggacgaagcccatgcattcggcgtaaggggaccgcgcggcctgggctgcgccgaagaaaccggatgcatccgggatatagatttcctcgtgggtaccttcggcaaggcagcggcgtctgccggcgcatacatcgcctgctgccggacgatacgcgagtatctcgtcaaccggatgcgaaccctcatcttcaccacggcattgcctccgacaagtattgcctggacactgtttatcgtgcggaaacttgccggaatgcagaaccgccgcgagcatctggctagaatcggccggacgctgcgcgaagcattacaagccaaagggtacggatgccccagcgcaagccatatcgtccctctgattatcggccccagtgccgacactgtgctgtgcgcagagttgctgcagaggcatgggttctatgcactgccggtacgcccgcccacggtgcccgaaggaacatcacgcatccgcttctcattgacagcggacatacgggaagatgagattggagaactgattccccttattcccctaaaggaagagaagaatactaacgctatacgattctaaaaacagatgaaacaaagttacattatacacgaacatcatccccggctattgctgttctttgccggctggggagccgatgagactcctttcaaaatgtatcgtccggcagccagcgacttcatggtgtgctatgactaccgcacactggattttgacgcctccggactggaaaaataccgcgaaatcaacctcatcggctggtctatgggggtatgggcggcttcgcagaccatgccacagctctcatcgccaggtacgtccggcgaaggtatccatatggcaaacagcatcgccatcaacggaacaccctaccccatagaccagcatatgggtattccacccgccatctaccacgggacattggacggactgaccggggcttcactgcacaaattcctccgccgcatgtgcgccaacggagcagccttcaaagctttcctggaaatcactccccgccgtccgctggaagagttgagagatgagttgacggagattgagaagatgtaccacacactgcctgctgccaccttccactggcagcaggcagtaacgggaggcaacgaccgcatcattccgccagccaaccagctgcaagcctgggaaacactcggcacccccgtgctgcaaacggaggatgcccactatcaggaagagttattcagacattacctgcaagacctatggacaagccactgaacccgatggacaaacaactgatagcctcccgctttgccaaagcccggaatacctatacccgggaggcccgcgtgcagcaacaagtcgccgagaagatgatgcagctcataaaggaaccatacacacgtttccaccgtgtcgtagagtttggctgcggaacgggaagctactcgcgtatcctcctccacaccttgcaaccggaaaccctgctgctgaacgacttgtgccgggaaatggaagagtgcgtcaaggaactttgcgacggcactaccgtgcagttcgtccccggtgatgccgaagccatcgacttccccggagaaaccgacctgataacctcgtgctccaccctacaatggttcaacgacccaggtgctttcttcacccgctgccaccaagcactggtggcagacggcctgcttgccttcagcaccttcggcgccacaaacatgcacgaaatacgccaactgactgggcacgggctggactatccctccattaaggagctgcaagccctgctgtctcccggcttcgatattctccatgccgaagaagaggtgatatccctgcccttccccactccccaggcagtgctgaagcatctgaagcaaaccggagtcacgggtacggaaaaaaggatgtggacgcgtggccgcctgcaatccttctgcgaagaatacacaacccggttcagtgatgccgcaggcaacgtaagcctaacctatcaccctatttatatcatcgcacgaaaaaagacaaaataatggaaacaaaaaacatctacttcatcagcggcattgatacagatgccggaaaaagctattgcaccgcctggtatgcccgtgagcttatgcaacgcggcctgcgcgtcatcacccaaaagttcatccagaccggcaacaccggccattccgaggacatcgacctgcaccgccacctcaccggaaccggctacctgccggaagacaaagaggggctgaccatgcccgagatattctcctacccctgctccccccacctcgccgcccgcatagacaagcgcccgatagacttcgtgaaaatagagcgtgccaccagggaactttcccaccgctatgataccgtgctcgtagaaggagccggaggtctgatggttcccctcaccgaagatttcctgacgatagactacattgtggaaaagcagtacccgcttatcttcgtcacctccggaaagctgggtagcatcaaccacaccctgctgagcttcgaagccatcaagaaccggggcatcgcactcgatacggtactctacaacctctatcccaccgtggaggataagactatccaggaagacacgatgaaatacatcaagcagtatttgtccaagcactttcccggaacaaagtttgaggcagtgccggaaattgcgtaaatttgcagcacataaacgtcctactgcacatggaagcatttacattagattcaactgaaattatcgtactcgccgtagcgggtggtctgttccttattcaaattatctactacctctgtctctacaaccgtattcatgcacgccgccgtgccgtgaagcagggaaacatgcacttcacccaggaactgccccccatatccgtcatcatctgcgcccgcgaggaatccgaaaatctgcgccgcaacctgggcgccgtgctggagcaggactatcccctatttgaagtcatcgtcattaacgacggcaacactgatgagagcgaagattacctgaccatcctcgaggagaaatacccccatctctaccacagcttcgtgcccgattcctcccgctacatcagccgtaagaagctggctgtgacgcttggaatcaaggccagcaaatatgaatggctggtgtttaccaatgccaactgcatgccccaaagcaaccaatggctgcgactgatggcacgcaacttcacatcacgtacccaagtggtgctaggatacagcggctacgaacgcggcaaaggctggctgcacaaacgggtggcattcgacaatctgttcacttccatgcgctatctgggatttgccctggcaggcagcccctacatgggcatcgggcgtaacctggcctaccggaaggaactcttctaccaacagaaaggattctccgcacacctcaacctgcaacggggagacgacgatttgttcatcaaccacgtggctaccccggagaacacgcgggtagaaacggatgccaatgccattgtacgcatgcaaccgcttctgcgtgccaaggactggaaagaagagaaaataggttacgcctccacagcacggctgtatcatgggatgcaacgctggctggccggttttgagaccctgactcgcctggtattccacgcatcctggatagcagcgatgttcatcggcattatgcacttccactggctggcagcaggcgtcgcttgtcttttgttcctgttccgtttcaccctgcaggccgtcattgtcaacaagactgcccgcgacctggaagaacaacgtagatattacttcacactaccggctttcgacctattgcagccgatacagtctttacgttggaaatggtactgtctgttccgcaagaaaagcgattttctgagaaagtgattctcttattcgtaacggatggaagttgccggatggatgcgtgtaatcagaaatgaagggcccaacaacatcaggactgaagccagcaatgtaccggcattcagtagcaggaacagccagatattgaaagataccggaacagtagccatataataggtctcagggtcgagcttgaacaagccggaccagcgctgcacaaaatagaatgcaaggccgattatgttcccccagagcatgcctttcccgatgaggaagaccgaaaaccaaaggaaaactttacgaatagtaaagttgttggctcccaaagacttcagcacacctatcatggaggtacgctctatgatgataatcagcaggccggataccatggtgaaccccgccactccaatcatcagaatgagaatgacccagatgttgacatccaagatgcccagccaggcaaagatttgaggattgagctgctctacattgcggacgcaatactcggcgccataacggtcgggattcccgtccgtatcggcagctacctcataggtggtttcttccagcttgtcataatcgcgtatttccagctccacgccactcacctggtctggctcccagttgttcaggcgattcaccaggtagaggtcggtaagcaggaataggttgtcgtattcagagaagttggtttggtagatacctgcaatcttcaggcggcgggcacgcacatcgtcctggatgaagtaggtgtctatcttgtcaccgagtttcaattgcagcttgttggcaagagactttgagatgactacgcggttggacgaagcagaatcgctgaattgcggaaactccccctccagcaaatggcggtggaagaaggtgctatcatactcctgccccacacctttcagcaccattccctgaaaggcatcggcggtctttatcatccccggcttggtggagtagcgttgtacatgcttcacttcgggataatcggaaagcgcagccatcatgctgtcacccaccaccaccggacgcgtctcgtatgagcgtgcagcatccaggttgcctatctggatatgggcaccgaaacccacgattttatcccttacctcgctcttgaagccgacaatgacggacacggcaataatcatcaccgccagtccaagggcaatgcccaccatggcaataaggacagccggacgggaaacttgcttgcccggctccgagttgcgataaatgcgcaacgctataaagcgagatagattcatgggccattattttttaggcgcagattacacggaagatttgaaacaaacgtctttatcttaagttttccgtgtaatccgcgcctaatgaattatttcattttattcggttcgccccggataggcttccaatgctttttgcaggataaacaaggcgcggttcaagtcatctttcttcagtacgtatgcgatacgcacttcgttgcgaccagaacccggcgtagtatagaagccggacgcaggcgccatgaataccgtctgtccctcgtattcaaactccgacaggcaccaggcacagaacttgtccgaatcatctaccggcagctttgccaccgtatagaacgctcccatcggaatgggcgaatatacgcccggtatgcggttcaatccgtcaatcaggcatttacggcgttctacatattcatcgtatgtgtcgcgcagataatcctcatcagcatccaacgatgcttctgcggcgatctggccaatcaatggaggactgagacgcgcctggcagaacttcatgacagcatcccggatttccttgttcttcgttatcagggcaccgatgcggataccgcactccgaatagcgcttggacacggaatcaatcagcaccacattgttctcaatgccttccagatggcaggcagagatatagggagaacccgtataaataaattcacggtacacctcgtccgagaagaggaacaaatcgtacttcttcacaaggtcgcgaatctggttcatttcacggcgtgtatagaggtaacccgtaggattgttgggattgcaaatcaaaatggcccgcgtgcgctcgttaatcagctcttcgaacttctctaccttgggcaacgagaaaccctcttcgatggtcgtggcaatggtgcgtatcttagctccggcagagatggcaaacgccatataattagcataggccggctcgggaacaatgatttcatcacccggattgaggcaagccaggaaagaaaacaagaccgcctccgagccgccggaagtgatgatgatgtcgtctgcagtcagattgatattgtacttcgcatagtaacctaccaacttctcgcggtaactgcgataccccgcactgggactgtattccagaactttccggtcgatgttccgtatcgcttcaatcgcgacttccggagtaggcaggtcgggttgtccgatgttcaggtggaatacatgtatgcccctctgcttggcagcatctgccaaaggagccagttttctgataggagatgcgggcatctccattccgcgaatagatattgttggcatgaggttatttactatttgacaatttacaatttactatttaatagactatttataagtgatattgctatcactttatcattaaagttgcaaatgtagcgaattatttgaaaccaaaaggaaggcaagaccataaaaactttaaaaaacttatctatcgtaaaaactctatgatatgtaaacggaaacttgtatctttgaaaaagcaaacgaaccaagctggctcaattgtaaatagtaaatagtcaaattgtaaataacaccatggtcatcaaccttataacttttgcttccatactgcataaacaagcatcagtccgtagctcccacgaagtgatattgactgaattggaaaaatactttaccgtcaacttcattgattacaaagatatagacaagttatcacccgatgacttcagtattatattcattgccaccggaggtgtggaacggctggtaatccagcatttcgaatcccttccccgccccgccatcctcctggcagacggcatgcagaactcactggccgccgctctcgaaatatcttcctggctgcgcggccggggaatgaaaagcgagattcttcacggagagctccccgaaaccatcaagcgtatttttgtcctgcacagcaatttcatggcacaacgcagccttttcggcatgcgcatcggcgtaatgggcactccgtccagttggctcattgccagcaatgtggattatctgcttgccaaacgccgctggggtatcgagtacacagacgtctcattggaccgcatttatgaatactacggacagataacggacgacgaggtgggcgaagcatgcgccggactggcaggaaaagcgcttgcctgccgagaggcaagccccgaagacatgataaaggccatgcggctgtatcgagccatcaagaggattgtagaggaagagcgactgagcgccattaccctcagctgcttccgtctgatagaccaaacgggaaccaccggctgccttgcccttgccttgctgaacgacgaaggaatcattgccggatgtgaaggcgatttgcaatccgtcttcaccatgctggccgtaaaagtgctgacagggaagaaccctttcatggccaatccttccatgataaatgcccgtaccaatgaaatcatattggcacattgtaccatcggtatcgcacaaacggagcagttcatcatacgcaaccattttgagacggaaatcggcatcggtattcagggaatcctgccgacaggagatgtaaccatcgtgaaatgcgggaacgaaagtctggacgaatattacctgagcaccggcacgcttgttgagaatacaaactacatcaatatgtgccgcacccaagtacggataaaaatgaactcccctgccgactatttcctcaagacaccgctgggcaaccaccacatcatgttacacggcaattacgaggatatattggaggagtttctgcaagccaatgcctgcaaacggattgaatgattattcgttcgcatccggtatcaccacctcgaaacgcgttccttttcccaactctgaggagaccgagatagaaccatgcaagcggtctacgatggtctggcaaatgctcagccccaaaccggcaccctgcgtaaagctgtcttctttgtagaagcgttcgaagatatgtttctgggcgtcttcggagataccgcttcccgtgtcttcgacaaagatggtggtatatccttcccggttcgtgacgtagccgaaggtaatgctgcccgttaccgtgaatttcttggcattgtttatcaggttgttcacgacctgcttcaagcggacggaatcggtgatgaccaatttgtcttccccttccggaatctttatacgtagctctacatcccgaggcatactcagacgctgggattcatggacttcctgcatgatgaacgccagattgaatgctccgaacttaaagtccatcgtgcccgattctatgcgcgagaggtccagaatatcgtttatcaacgccaacagcaatgtacagttgatgttgattgtttcgacgaactgctttacctcttccggagaaaaagcgtccaaatccttcaacaaatccgagaagccgacaatggcattcaaaggggtgcgtatctcatggctcatattggcaagaaacgcagatttgagcttgtcggcctgcaaggcacggtcacgtgcggcaatcaaggcctcttccgtatccttgtaacgctggatgctctggcatactcccaataccatgtatggggtatcaaccgtcagtccgtcataagcggtactgcggaactcccaccattcatagctcccatccgcactcttcaaccggaaactcatccgtgaattgatttcattgcccaacagaatggcatcaaaattcctgcgcgtatgtagcaagtcttccggatgtataagggtgtccatctcatcacgtgccagcaagtccgtatcaccggtatacccgaaacggcgcagcaatccacccgggaaatggaaacggttcatatgcatgttgtactgccacggataaatggagctttcctccaccgccatattgaagaagcgtctctgcatctcttcttcggagatattgcggcatacaatcgccattcccgtcatcttttcattggcaaagataggtactacctcgccggaaacggggaaatacgttccctgatggttttcctgcatgaaggctttctccggaatagaaataggtctctttccggtacgtactttcttcaacaagtcctgcaggatgttttctccattcatgtaaatcctgaaaatggagccggccatctgcccttcatagaaacgggacgtataggtttcggaagaaagtcccagcatctgtaacaacggacggttgacaaaatggatgcgcaggtcggtatcatacgtaatcaagccgtcgcgaatggaacagaagatattgtcgaactcgtcgcgctgctccaccaggcggtgctgtatcaacaagcgggtctgggcatgtatgcgcttacgcgactccctgcggttggcacggaaaagccaggcaaccagcagcaccaatgccccgacaatcagcgaatagaacagaatgaaccagacacggtaacgctccatcaacggtatattcaaaatgatgcccttgctctccgcacggttcgtgtccacacggaaaaactgcaactgtttgtaatcgaacagcaacttgcccccaaagtcctttactcccaatgaggcgggtgacttgcccttcaaaatacttgcagcctgccggccggcagcaaaggcatcctctccgggaacggcatcatacacacacagcacaccgttcgtcatagccaggttctggctggtaaacacgggagccttcaacttcaaggaaagaaaaggaatccatttgggagctataacaatatgcttgtaggcattgtagtcatagcaaatggaagtgatgatagagttcaaggacttggcctgcacgttcagcactttcaactcatgctccggatagttgctttttatgcgttcccaagagtcttccacagccctgacccctttaaggctcaggaaactgctgtcggacagacaaaccaactccctgcgggaagggaacatacggacagccgcatccagcaagacatcgaaatccgttttcgaaacatggccagagacgttgggcattctttcaaagaccctctcatccgggtatttgatgcccgaaaccaccaccggtatctgataaggcagggaatcaccgcaatgggtcaatgtgaagaaagcctcatcgctggaagtcacaatcaagtccgttttccgttgcctggcacgctggcaaatgcggcgcatgatgaaacattcggaagcgaaagaccagtaatcggcattcagatattcggtaatgatattggctctaactcccccctttttcagtccgttctccagattttctgtcaggaggctgtgccaaggagtattttttgtataagactgtatgaaaagtacattgtacgtacgttccgcagccgaaagtgttcccgacatcaaccacaacaagcctgcaagcaatggaaagaaaaggcgtttcatcataatatagattttgtatactcaacgcaaaaactcttattcgtcacgcaaatatacaagttatattgagaatgagtacagattactcaaaaaaaactcattcatcatgcaatgcttcggcaggctgcacctccatggcccgtgaagccggataccagattcctgcaatcaccattagtgccatcaatacccagacaatagaaacgcatatgacaaatctcccccaagtggcatccgtggcttctgtaaaagtgacatctgccataaccatgttaatacatattatcaaagccgggatagaagcaagcgccaacagcagcaacccttcacccagcaattgccaacgtatccttccacggctgctgcccatggccatgcgcaaggcaatctcgctgcgacgatggcgggtacggaaccagaaagttcccatcagcccaatgaatacattgaaaacgaagaatatcacaatgagccttgcactacggatatatggggtgattccttcggcagcatcccgttctatcttctggtccttatagctctgtatgtcgaaaagatagaatggagcgacctgcagctgcgacgtcatatcctgatagaaacaggctgcaaaattatccgtatctgcctccggacgtatccgtagggagatgaacggaaggtactgggcctcatagaaccaaccagggaaaggagtcaggacaaaaggtccgtaacgggcgtaatcatccgtcttctgcaaggcacagactgcagagacacggtaacggagacctccgctgtaataatccaggaactcgcggcccaccgccccagtacttgcctgaaaaaggctgtctgccagatcacaggtcaccacggcaggcaaaggactggcagtggaattccagtctacgacattcccctgcaacaacggaatgcgcatgacgtcgaaatattctggagacacatagcgtactgtagtctcgacaacatgtacgctgtccgtcgcatacccctggtaaacacgcccgcgggtataggtatcggtacccaaccacatggccgcactctccacagcaggatatcgcctgatacgccggagcacctcctccatcggtttgaaccagaaggtctgcagactgtcttccgacgtgcacggcactatctgtgtggggttgcaggaaatccttatcttatagacatgctccaaatcataccccttaggctgccgttctgcataggtaaagccatagagcacatccacacaataccacatcaatgtaaatacaatcaacagctcggcaaacagccagccattactgcggcgctggttccatatctgatgtaaaatagaatgtatcatactcgttactgtttttttaattgggattcgtttatccgttcattctccaccaagaacctcggctatgggacggcgggtggcatgccaggccggaataaacacagaaagcaggttgaacaacaggcacaccaccaatacagccacgaaaaccgtgggacggaagaaaagccagacacttacatcaaaattcgttccgggagcgccatagccaagcatccaatccttacccagccataggaatatgcatgaaaagagaaaaccgagcaatgcgccggcaaatgccaaagccagattctcacggagcaactgcaccattaaagtagaacggctggcaccgtatgctttccttaccgcaagctcagccatgcgacgggacatttgcgaagatataagtccgctgacattgatagcaggtacaatcagtaatatcagacccagaattatgcaggttacggcagggctcatcgtatcattacggaagaactgccgttccgtataagtgctgagatcgggaagttccagtttatactcagtcagtgtctcgttgaagcgggcaagcgactgttctatctgccgcttgagctcctctctaccgacaccgggcctgacaagggccacagcctcgaaatctccccgtagcccttcactgcccaaatcggaattccgggtggaataaggcatccacaactctccataggcaaatgtgaacagagagctcacatctttggtgacccccacaatgcgtttagggcgaaagttaacaaaataattcttgccaatggctgcttcggcagacccgaaagcttcgcgggcaagctgttcacctataaccacaacatcccggcaagcatcgaactcttcggtactgaaaagacgacctgccacaagagggatgtcgtagacacgccaatagttcaaatccacctgacgaaccgtgcggcgcattccccgcgctggcgactccccacagtatctaagataggtaggtcccagataggtgacaagttctgctcccggaagttccttaaaaatagcgttgacagcccgataagacatacccgtattggaattgctgcggtcggacttacggtaagaatatccataagaagaatataccatactactgcggtgcgactcgggagccaagtcagccgtctggatgtcatacaccatgtaaatgaccatgacaaaggtgatgctcactgccgtaccgatgacggaaacagcactgaaaaagggattctggcggataagagctaaaatttgtttcataactttctattcatcatgtaatgcttcggcaggctgcaccttcatggcacctcttgccggataccaaatacctgcaacaatcatgacagccataagcgaccaggttgccacaacagctgccagaaaacgccctccgccgaaaggaagtttctcaacatccaccaactccgccattcccacattgaaggcaataatgacggcaggaacggctgcaagggtaagcagcaatataccctccgacatcagacggaggaagacaccttgacgcgaacttcccatagccatacggagtgccacttcacggcgacgctgctgtgtacggaaccagaaagtgccgataacgcccagaaaaatattcatcaacagaaagccgagcacacaaagctgggttttggcttcattcatgtcctcacgttcgcatatctcgcgcaaatccttgaaagaagttacatcgagcagatagagattccctacttgatagaggcggtcagcatcctccataagcttctccataaagccggaatcggcatcaggacggacacgaagactgagagtgatgtatcgtggatttccatattctttcagtctgtcaaggttaagatgcaaagctgcataagtacctccccactctgaagaagtatagaagtgcgaccaacgtacgggtgtgccgacagcccctacgcggcaccgttcatcactaccgaaattcaacagtgtaagttcacggtcttgtaaagaagctgcattgttcaggtgcaattcaggataggctgcaaaaagattggaagaaacgaccatatggtcatcccgtatggcagcggccatgtgggtcaacatctcctcatccgagctaccataacggaacacacggaaaaaatcaggttccacccaaagcagatgaacattctccgatatagtatccagccccaaattgagaccgttgctaccgtcattataaggaaagcaattctgagaaagtgccacagcttccacacctggacgatgcctcaaacgttcggcaagttccacaagatgccgcatatcatcgtccttggtcaaatcgaaattataagcagtagacttgagagtaagcttactgactgcaatattatagcaatgttccgtatcaaaacccatcggggcattgtaaacacgaagagtaaccagtgtccagtccacaatgtaccaaagcaccacaaagaccagcagcagttccgtaaaaaggaaaaggctggaacgccattcattcttaatctgaaccaatatattcttcatatgtcattcccccctctgattgattgcatccactatattcatcctcgaagccctccatgccgggataccggctgaaagcaaattcatcagcaaacagaaaccgaaagccgacagaaaagcccatggagaaagtaacatgccaggtgtcagtgaagtgtctccatttaaataggcattggcgctattgccaaagaggaagccgttcaataaaaaagtagcaccgtaactcaaagccagccccagcatacccgccaacagagagagcagcaggttttcgaaaaacacctgtcttaccagttcactacccgtagcgccgaaagctttgcgtaccccgatttcactcatacgcttccgcatccgcgagagggtcatggaagaaaggttgatggcaggcaccagtagcaagatggtgatgacaagcgcgtaacgcaaaacaatccccttcatatccggcaaatggtcccatttacgatacagattggcaaacaccccatcgggttggtcacgataaaaggtttccgcttcggatagaccggcgttatacgcaaggcgcaatctctccgcctcttcacgaatagccggaaaatcggccgacgaatgtgctaatatcacagccttcatctgccccatcgtattttcccaccaggcaaaaccagcagcatcggtcgaattataaggtacccacacttgcccgtatgctgaagtggcaagcatggaaacatcggccacgacacctgaaacccggtaatccacatgattcagttgcaatgtctgccccgttacctccgtagtgccgaacaaccgacgcgccacggtagccgagataacggcacaaggtattccggcatcgctgtctgccttgctgaaacctttaccactcaaaaaacggaaacggaagatgtgccagaactgttcgtccgtctgcaccatatccgctgtcagctttgctccagcgagcaacgacacacgcactttttccggtaaagatataagcgtgacggcctctgccgtagaaagctgtttaaaacatcccttacccgtctgtacagacatgtgcccatatgccccatggtcagttcctttataccttactgccatggtagaaacataaagcgaacgcgagcggtttatctccggctcacaatctaccatacgtacttgcagggtgatgacaagcaccataatcatgcaaatggcaagagcggtacctatcacggacacccaagtgataatgggattctcccgcaaatggtagaaggcttgctgaaagtagagacgtatcataaataattaaaaattgaaaattaaattattcgtcgtgcagagcttcggcgggctgtaccttcatcgccttgcgggcggggatgccgatgccgataataatcatgagggctatcaacacaaagctgatcgcggcacagagcagcagacggccccactccaatgtcgtaccgttcctccaggagttcaattccagattcgccagattatagtcgatgagcaatgcaacaggagtgacaattgccaacaataatatcccttcactaagcagccggatgaagatggcacggtctgtcgctccatgcgctttgtgcagcgctatttccgaacggcgttgctgcgtacggaaccagaatgttccgagcaagccgaggaagatgttcagcagcaggaatcccatacccatcacatagttacggatatcattggtccatgcctgctggaagttgcggcggatgtccttgaaagaacgtatctccgaaatgaagatgtttcctacgcgaaactggctctcactgtctgccttcaacctctcaatgaagtcattgtcctgcccttcacggacacggacacaaagttcgagaccgacatagtagaaattctgcttcaccatcatggaatatgagcttcgtgcctggtcgtaatcgtgatagcgtacatcttgcaatgcggcacccagccggtaggtcttcgttgtgtccccaaagagatggaaccgctggcccacaaagtcggtcatcctacggtcatacttactaaaaaggttgtccgaagccatgaaatctccgcgttccaacatttcagccaattgttcgggtgtctcgccacgcgtgccccgatagcgaaatacacggggaaaatccggtgtcaccaacctccggatagtccaaccgggagaacgcaacgtatcgtagctcacttcagcgcttgaattgcttccattgtaagggtacgaattctgtgaaaggctcaccgcctctatctctggccggtggcgcagacgctccagcaacttggctatgtcatcgtgggtctgctgagaggtatgcccggctatgtagtcggggcttttgggtgtcagttcacccaactcgatgaggtaacaatgctcgatatcaaagcctttcggctccaggtaggtagcggcgcgagtatagagatagtccaccacgtaccacatcactacgctcaccaccagcagctccagcaccaaccataggtttgagagccattcattctttatctgtataagaagtttcttagtcattttcttcagcgattaatgtttagtgacacgggattatttatgcaagcgtccacccaatgcatttacaatgcctaccctcgatgcacgccatgcgggaataccggaactcaataagttcagcacaaagcagaacagcagtgcccagccaaaagtagagccatgcagcaatatacttgcatccacggcgggagggctcagcgtctggctgaattcctgggcaaacagcagggtatttcccaaataagcaaacacgacgctcagtaacaatcccagaatccctgccaacagtgtcaccaccaaattctctgcaatgatttgcctcatcagttccagtcttgttgaaccgaatgcccggcgtacaccgatctcagccacacgctggcgcaaacggctctgtgtcatcgagctgaggttgatggcaggaacaatcagtaggatgatgaagataatgaggcgctgtctgcgcgcctggtccacgtccggttcgatgttggcagccatgcccgcggcactcttctcctggtcgtagggacggttgcggtaaatcaacgaataaccgttctcaccgattatcgtgttgtactcctgacggcggcgctccgtttcctcgcggatggctggaaaatcttcgcggctttttgccaggatggtgacgctcatcatccccatgtgttcgtcgctccaggtatccttcgttatctcagtagaggtatagggtacccatacctgcgcgtaagctgtgttggctaaagtagaaacatccttcactacgccggccactgtataaggagcatggttcaagaggaattcacggcccacggcctccgttgtctggaatagccggcgcgccacactttccgtaatcactgccacgggcagtccggcgtcgaacgtagcccggtcataggcctttcctgcaacaaacgaaaaatcgaatacatgccaaaaggtatcatctgtctgcaacaaatcgatacccgttgcaggttgtcccggcagattcacgggggtagaaaccaccatgcaggtataaatcgttaccgcttccggtgtcttcagcgatttaaagcactcgagcgccgtctttatacccatcggtccgttgctggttccatcgccccaactcttgttggtaatgctcatataatgggcgtgcagaaagcggtcacggttactttcaggggcaaacggggccaccttcacctgctgcatcatcaccaccagcatgatgaggaagatggcaagtgccgtaccggctatggtgacggcactaatcatcggttgctgccgcaactgtgcccaagcttgtgtgaaaaattgctttatcatctcaacggcctattttcaaattatcagtatttacctcgcctatgcctcttttagaaatgtcagcatgcccggcagttccactcaaagtaatttcaccgactccacctactttggcagagagataatcgcaaactacatggatgtcggcactgcccacaccacgtaaagccaccctcaggtcacggcaagtcaaatccttcacatgtacatcacccacgcctttcacttcaaactccagcttatccagcttcaagggttcctcacagttgaattcacccacaccgataaattccaccatctttaagtccggagccgagagacggatggtaacaccgtcattttggttgcgcaccttcttatccttgaagccgatggtgagatgaccatccttcactgtgctctccgtattcttcacgtacttctcccgtccttcaatctgtagggagtaactgtcgctctgtgtgaaataaaccgtacccacagaagttatcctgatggatgagaatgcctccaccttacgtacttcactcactttgttatcttgtccccatgcacaaattacgcctgcaaatgccaatgccaatgcgatgataacacctataatatttgtcttcatattcttgcttatttattacgatgattacttactcaaaaaacagataatatatttagtacgaacggatgatatatttgccccaaacaagtgatgtgtgcgatacaaacagatgatacgttcttttttatcgttgatattattttcttattcttcatgtaacgcctctgccggctctatcttcatggcttgccgggccggataccaaatacccatcatcaccatcagtgctatcaacagccaagcacctaatgagcctatcaggaaacgtatcatgctccactctaccggccaggtcgcaatcaatgcagtacgtccaatggtgaattcgccgacacctacgttgtaacataccagcatagcaggcaaagtaaccaacgccaacagcagtaacccctcccccataagaagggaaaaaacctgatgcttggtactacccatcgccaaccgtaaggctatttccgagcgacgacggcgcgtacgaacccagaaagtgcctatcagccccaaaaagacattacccaaaaggaacaataccactattgtctgactattcactttgtccgtatctccatacatcacttcaaactgtgcctgcatttgcgtgtaaggttccgcatcggcaacaaatatattgtccgtatccagcctcggtgctatctcgcggagaaattgttcccgatagtccggtccgtcggctgcaggctttacacggaaaactatctgtgcctgctgactaccgaattcctcacgcataagttgctcgcccaggcgcataaaaatccaatgagcgtcattaccatagcggtaatcgcggaaactgccgacaatgccaccttgagtaacagtattcacagtatctccacgccatttcatcggtgtgttgagtgaaaattccggtagccgttccttgaaggcatcggcaatagcctgactcaacatcacattattgatgccgataggcaaagcggcaaaagtccgtccttgttcctcctgcatatggaaaacccgggtatatccaccggtagcataaatcatacgcccgttctgcccgatggtatcttgtacagccagcgagttataactatttgcgccactcataggcaaactccaataactcaatgaagcggcctctacagtcggttcttgttccagccttttcaggatattcagatacttgtcggcatcgagcaatgcagtatcacgactctcgcctccctgaaccgtagtaagacgataaacatggtcgatatcatatcccaacggacgatagaaagtatatttcatacatcccagagagtcgcaaagaaaccacatcacgatgaataccaaaaaaagttcggccaagacccacccactattgctcaggcgtgcccatatcatgcgtaagttgtgtaaaatgaatttcataatacttcttgttttatttatcgttcagtgaatctacaattgtccgtcttgctgccatccatgcaggcagtccggcactaagcgtattgatgaccacgcagaaagcaaaagccagcagaaatacccagggactgaacaatgcctccatgctcaagctaaagtcaccggctgtaccgacattctggctattggtaaaaagccaggtacgcattccccatacagctacgtagctgaacaataatcctaccacaccaccaagcagtgtcagtaccaggttctcattcagaatttggcgtatcagtacaccgcgcgttcctccgaaggccttacgtaccccaagctccgaggtacgctgctgcatccggctgttactcagcccgcacaaattgagcgacggcaccaacagaatgatgaacaatgcaatggcatattgcaggtatagcatcgtcacatccggtcctacgttagcccatacatggttcacatgcgccacgatgtcatccggttgctccatgatgtctatctgcatatctcccaatcctgcattgacagcctctatccgtttggcaataccttgactgatagccggaaaatcgtcggatgtacgtgccagcacagcaatatgaacactaccaccataactccataccgaagtcacttccaacttatcggccggatacatactccatacttgtgcgtaagcatcctttgcggtgacagaaacatcctttaccactcctatcacacgcgccggttcgcggttcaacaataactgctgtcccaccgcatctgtcgtaccaaacagtttccgtgccacagaagcacaaaccacaacagcctttgtacctcctgcacgatcctcttcgccaaaaccgtgtcctgccatgaactgcaggctgaataccttccaaaagccctgatcggtctgcatagcatccacctttacccggttgctaccatctgtaagagacaccaaagcggcactggccggaacaaaagcagtacaagcttccacttcggataacggctgtatacattctttcataaatgccggtgaaggagtattatagttttgtaccccctcctctgtcttgctgcttatatgcatggcagaaaagtaaaggcaccggctacggttcacttccggttccaaatcggcatacttcgtttgccaaataatcacaatagccataatcatggtaatggcaaacgccgtacccagtatggaaattgtactcagcagcggattctgcttcaagatagtaaaagcttgtcttacggtttgcatttcatttattgatagttgataattaatagttgatagtttctaagcagtaattattccacctgacgtccgtcgaagaagcggatggtacgcgaggtctgtttggcctgctcttcattgtgagtcaccatcacaatggtacgtccgtcttccttgttcagctgatgcaacagctccatgacttcggcacccattttggagtccaaattaccggtaggctcatcggcgaggattatctccggattgccgatgatggcgcgggcaatggctacacgctggcactgtccaccggagagctgtgtaggcatgtggcgcatgcggtggctcaaaccgaccttcttcaacacctcttccgccagacgacggcgttctttggcagacacctttctatacagcaaaggcagctccacattatccaatacattcagcgagttaatcagatggaaagactgaaacacaaaacccagcttctggttacggaaagcagccagctccttgtccttcatgccgtccactttcgtaccggctatttcgatggtaccgctggtgggtgcatccagtaaacccataatgttcagcaacgtagattttccgcaaccggaaggtcccatgatactgagaaattctcccttgttcacttcgaggtttacattttccaatgccacggtttcaatctcgtttgtacgataaatcttgttgatgccagttaacttaatcataatggtaagtatttaattgttattattctgttctgtttctattccgcacaatttctgcttcaagaggtcaaaagttgtaccaaaatcgtttattattgattatctgctatttatacatgcagtaaggtgtccgaaaatgaacaccttgtccgttttcatctatccgtcacgcagggcttccgtaggtggaatgcgactgatactgcgcgccacagtttgttctgcttcaacagttcccagacttatttaagtaagactttatcatttcaatttcaacttattcttgttcttatagttactcatatcactcaccaccacttcatcacccggttgcaagccactgaccacttctacaaactcaaagttggaatcgcccaactgcaccttgcgctttacgatttccttatcggaattgcgtacaaaaagttcatactccccacgtcccacataatagctggcattggctatgcgcatcacgtcttccttcaccgcattcatcacgtacacatctgtcttcagaccggaacggagacggcggttattatcttcattcaactgcacggtaaaggatattacaccattctttgaaagcggagtaacactgcttacggaaccttccaacttttcgctgccaatcttcacaatggccttgccgccggcagccacacggtcaccgtaagtatcggcaatctcgccttccaccttgaagtggctcaagtcggagatgacggcaatctgggtcccttcaggaacctgagctccaatctgattgttgatataagtaaggatggccttccggggcgaacgcacctgcgcgtcatcgagcgtacgtttggtttcggccagtgtcttctggaacatgctgaaatccaattcctgcacttggtattccgcagccaacacttccttctcgttggcatactgctgctgtaattgctcgtattccagttgtgcaacgttgtagctcagttctgcttggcgcactttgtcagtggtgccggaaccgaggctatcgaggtactgctcgttgcgcagctccaccttcatgcggtcaagcttcatggcggagactttgattttcatctgaaggtcggtcagcttggtttggttgtcaagtttcagctgctttagcttgtagctgcgcatctgctcttcgtccagcatcttcttgtagtcggtttcggcactctgtaagtccagtttcaggataggagtaccgacatccacactatcgccaccttttctgtacacctccaaaatgcgggtattgatgggcgagttgataatttcctcgaatgccggaaccaccttgccggaggcgctgacactgacttcaatcgtgcccttgcctactttggagaacacaagatctttctctttcactcccgcacgcatcaatgaaatgagtacactgaccactacgatacctgccacgccgatagcaccgtagcggataattttcttattgcgttctttattacgcacttctttcggaatttctctatccatatctttaaattttattgtttgcgaacataacgcttaatatatactaaattcatgccaaaatcataacccactgaaagtaagcgaaaagacaaaaaagaagggtgtccgttttcggacaccctgtacattttcggatagattctttatcttaatctcaaacggtcgccaatctccggcacgtattccgcatccttgcgattcatcttataaaggttcttcagacgaatgccgtacttttgggaaatggagtgcatggaatcaccatccttcacaatgtagacagtatggggtttagcggctttcttacgcttttctttcaagtagatgatgtctcccgcctccagtgtatattctttatggaggtcgttgtatttcaccagcttcttccagctgatgtcaaactccttgcccaacacctggaaggtgtctccgtcgcgtgccactacataagctatatcgttggcaatgtacacctgatgcggattggccagccaaggcttctttttcagttccttctcccagctgcgggcatcgcgcttgctcatgccacggctgtcgtacttatacagttcataatcctcgataatggttatcagtcggttggcatacgacgggtcggtagcatagccagccttcttcaagccgcgcgcccaacccttatagtccgtaatcttcagtttgaaaagaaaagcataacgtgctccccttttcaagaaatcggaatggtcttcataagagtctttcggattgcgataagcgcggaaacattcattgcgggcatcgtcatcatgcctcactgtccgtccgcgccagttgcctccgcacttgatgccgaagtggttgttgctcttgcgcgccagcgcgctgtatccggcaccgctctccaacagcccttgggccagcgtgatgctggcaggtatcttatgacgctgcatctgctccacggcaaggggggcatactgtttgatatactcattgtagcgggcattccggcgttgtgcctgcactgttgtaatggaaataaaaagaaatgctatgatagcagtcagtctgaaaatccgtttcatgcttaaaatgttgagttctgcacaaaagtccgtaaaagaattgaaataaccaatctcttttctatctttgtaacattaattacaatataaccctttgccttatgaaagaattaaatatcgaaatcgccgtcaagatatacgactatgaagaactggatgccgccgaccgcgaactgatggatgccgcccgcgaggctaccaaccgcagctatgccccttactcccacttctcggtaggagctgcagccagactggcaaacggtattgtagtgaccggcaccaaccaggaaaacgccgcctatccttccgggctgtgtgcagaacgcaccaccctattctatgccaactcccaacatcccgaccaggcagtaaccaccctcgccattgctgcacgcaacgagcacgacgagttcctggagtctcccatcccgccctgcggcgcctgccggcaagtgatgctcgaaacggagaagcgcttcaagcagccaatgcgggtgttgctgtatggcaaaaagggaatctacgagctgaagaatgtgggagaattactgccactctcgttcgatgcttcggccatgaagtaacagaaccaataaagtattaacatcgtgtctgcaggaagttaatttcttgcaaacacgatattaacttcttgccgacacgatattaatatcgcaaaaagcctttgttattcagtggaaatcattacctttgcgcccactaaccaattaattccaccgatgagaatatccgactaaagacaacacattccggtaaacatcactatcaacatgctttttcagactgaacgctgagcatcacctatatagatgtttagccaatactgtgtttgtctgtacccctccccttcgagaatttcaatttcggggaatgcttgcatctcccctatcattcttacttctaaaaacacagtagaaacttatgagctttatcattaaagaccttagctatatccatgcagataaggaaatcttgttttcacacctccacttgagtatcaactccggagataaaatagccctgaccggaaataacggttgcggcaagtctaccctcatgcgtattttggtaggagacttgtctccaagttcgggaacggtgctacgccccgaacatctgtactacgtaccccagcacttcggacaatacgaccggcagacaatagcacaagctttgggaatcagccacaagctatctgccctgcatgccatcctaagcggtgacgctaccgaaaagcacttcaatacgctcaatgatgactggaacgtggaagaacgcgcccagacttctctcgacagctggggactggacggtatcccactctcccgtccgatggaaggacttagcggcggcgaaaagacccgcatcttcctggcaggcatggagttgcacaacccaacagccatcctgctggacgaaccgaccaactatctggacgcggatggacgggaacgtctgtataacttgatacgacggacatcggctaccgtgctcgtcatcagtcacgaccgcacgctactgaatcagttgcctgccatctgcgaactctcctcccagggattgacgtattacagcggaaactacgacttctacaaaaaacagaagaccctgcaacaaaacgccctcacccaacaactggaagagaagcagaaagccctgcgccttgcacgcaaagtggcacgcgaagtagaagaacggaaggccaaacagaatgtgcggggagaaaaaaactccattaaaaaggggattccccgcatcatgatgggagcactgaaaaacaatgcggaaaacagcagcagcagactcagcagcattcatacggagaaaacggaaaaattgcaggcagaaatgtcaggtatcaaaagttcactgccacagacagacaaactgaaaacagacttcaatgcctctcatctgcatgtggggaaggttctagtcaaggcaaaggacgtcaactttcattatcccagcctcgcggcttctcctatggagacaacccgtccggaggcagtaaaggagctctggtcttcctccctcaccttccagctaagaagcggcgaccgcctcagcttgaaaggaaaaaacggcagtggaaaaacaaccctgctgaaactcatcatgggcgaattgcaccccaccgacggagtgatggagcgtgccggcttcacctccgtctatctggaccaggaatactccctcgtccgtaatgagcgcagcgtactccaacaagcagaagccttcaaccaccgccacctgccggaacatgaagtgaaaaccatcctcaaccgctatctctttccccgcgacgtgtggaacaagccgtgcagcaaactgagtggcggcgaaaagatgcgtctttccttctgctgcctgatgattgccgacaacaccccggacatgttcattttggacgaacccaccaacaatctggacatcgagagcatagaaataataacggcaacgatacgcaactacgccggcaccgtaattgccatcagccacgaccgggaatttctgaaagacaccggcatcgaacgggagatacttttggaatgaatcagtaatttaggtaacaacaaccgtaatttgtatactgccgttctcataaaaccggcctatttttgtagcacgtaatcatttactaactaacgaacaacgaatatgagcaaaaaagtattaatcctctcctccagtccccgcaggaatggaaactccgacctcttgtgcaacgaattcatgcgcggtgccgcagaagccggacatcaagtagaaaagattttcctgaaagacaagcacatcaactactgcacgggatgcagcgtatgcagcatgtacggcaaaccctgcccgcaaaaggacgatgccgccgaagtggtggaaaagatgattgccgccgacgtcatcgtcatggcaactcccgtatacttctacaccatgagcgcgcagatgaagacactgattgaccgttgttgtgcacgctaccttgaaataaagaacaaggagttctacttcatcatcgccgccgccgaagaaagtgtccccatgatggaacgtaccattgatggtttccgtggcttcctcgactgcctggaagagcccaaagaatgcggcaccatttatggcgtgggtgcctggaaggtaggcgagataaacgacaagccttccatgcacgaagcctacgagatggggaaaaaagtataaagaacgaatactaaacatttatgctacgtaccatcagactgacccttgccgtcatcttctttgcattcatcacgctgttgttcctcgacttcacgggaacactgcatgcctggttcggatggatggcgaaaatacaattcctgccggccgtgctggcactgaacatcggtgtagtactgtttcttgcagtgctgaccttggtattcggacgcatctactgctccgtcatctgcccgttaggagtattccaggatattgtttcctggctctccgccaaacggaagaagaaccgtttccgctattcgcctgtactgaaatggctacgctacggtgtgctgggagtattcgtacttgccattatcggcggactgaactcttttgtcgtgctactggccccttacagctcatacgggcgcatcgtttccagccttttctccccgctctaccaatgggcaaacaacggactggcctacctggccgaacgtgctgacagctatgccttctatgaaacggatgtatggatgaagagtctccctaccctgctgattgccacggtcactctggtggtcctcatcgtgctggcatggcgaggcggacgtacctattgtaacaccatctgtccggtaggtacagtgcttggcttcctctcgaagtattccttgctgaaaccggtaattgacacaaagaagtgcaacagttgtggactttgtgcccgtaactgcaaggcatcgtgcatcaacatcaaggcacacgaaatagattacagccgttgcgtggcatgtatggactgtatcagcaagtgcaggaaaggtgccatcacttacacacgccgcaagccggcctccgctgcagtctctcaggaaacctccgtggcaccggagcaggtaaacgacgcccgccgcgcatttctctctacaaccgccgtgtttgctgctacggcagccctcaaggcacaagaaaagaaagtggacggtggactggctgtcatcgaggacaaaaaaatccccgagcgcgccactcccatcactcccccgggctcactgagcgcccgccactttgcacaacactgcacagcctgccagctctgcgtatcggtatgccccaaccaagtgctccgtccttcttcggacttgacaaaactgatgcagccggaaatgtcttacgaacgcggttactgccgccccgaatgcgccaagtgtgcggaggtgtgtcctaccgatgccatccatctgacgagcctcgccgagaaatcggccatccaaatcggtcatgccgtatggattaaggagaattgcatctgcatcacagacaagatggaatgtgggaactgtgcccgccattgtccggccggtgccatacagatggttccttcagacccggaagacgaagcctccatcaagataccggtagtcaacgccgaacgctgcaccggatgcggagcatgcgagaacctttgtccgtcgcgtccgttcagtgccatttatgtggaaggccatgtgatgcacagaactgtctaaagcagctttatcacccaaatatccatttataatttcagtcctatcacaatgaaagaagacaagaacaagataaaccgccgcgatttcttcaagctcgccggtgcaggaacgcttgcctcggcagcagccctgtacggctgttcgggcaacaagaacaacggggagagcgaatcggccgcgctgggcgagataccaaccgacaagatgacctaccgtaccaatcccaacacgggcgaccgggtttccctgctaggatacggatgcatgcgatggcccacccgcaaacgcaccgacgggaatggagacgaaatagaccaggaagccgtgaacgacctgatagactatgccattgcccacggagtgaactatttcgacacctcccccgcctatgtgcaaggtctgtcggagcgcgccacgggcattgccttgaaacgccatccacgggagaaattcttccttgccacaaagctgtccaacttcagtcccagcacgcacagccgcgaagagtcccttgccatgtatcaccgctccttccgcgacctgcaagtggactacatcgactacctcctgctgcacggcatcggcatgggcggcatggaagccctccgttcccgctatctggacaacggcatgctggacttcctgctgaaagagcgcgaagccggacgcatccgcaacctcggattctcctatcatggagacatcgaagtcttcgactacctgctctcccgccacgacgaactgaaatgggacttcgtacaaatccagctgaactacgtagactggcggcatgccaaagaagtgaatacccgcaacacggacgccgaatatccgtacgccgaactggtgaagcgaaacatcccggccgtcatcatggagccgctgctgggcggacgcctatcccgcctgaacgaccacttgatggcacgtctgaaacaacgccgcccgcaggagagcgtggcttcctgggccttccgatttgcaggtactttccccgatgtgctgaccgtactgagcggaatgacgtacatggagcatctgcaagacaacctgcgtaccttctccccgcttgttccatgtacggaagaggagtttaccctgctggaagataccgcccagcgaatgctgcaataccccaccgtgccgtgcaacgactgcaaatactgtatgccgtgcccctatgggctggatattccagccatcctgctgcactacaaccgctgcatcaacgagggcaacgtgccgcagaacagccaagacgagaattaccgcgaggcacgccgcgccttcctgataggctatgaccgcagtgttccccgtctccgccaagccaaccgctgcaccggttgcggccaatgcaacccgcactgtccgcaaggcatcgacatcccggcgaaactgcaggagatagaccgatttgtggaagcgctgaagcaggaaaccctttaacggacttaccttcaaccctggttgtccattttaaggattaccaatcatatacagattcttctttttgtataattctggaaaactttcgttagtgccttatacaaagggctttgggagaattacccatttttgaggtaatgacttggcaacagtgccatttgcaacgttttgctgggatttgctttcactatcactcgtcttaggacaaaagtagtaataaaaatcggaataaaaaaggatatgaaaacattaccttaaaatccaaacttagattgcaattgcctattcatacttttagcgttgaattgtttcgataggacacaatcaaaatacagactggggaatttttgtccagaaaattgaggcaaaagttgttctatgaaacttagcccaattccagagagcgttggaattaatcccgaaggtaaaaataaagaagcactactaacaactgcccacctaaaccatttctcaatctgattattatttgaacgcccattcaataaagctaattctaattcctgaacactataattgtggttctctagccaagaggtaaatttaccaaaggctacattatctctaactcgaataatgtctttcattgaaataacattattgtagtataaaattgataggttcggaattcccttggaataaaggattaaatcaaaatattgaataatgctatcgttatgaatgtcacttttgtaaatcaagtatcgttttgcttcttcttcaaacaaaatttcatctgtctttagttgtctagaccactctaaacttcgttcaaataaacagagccttacagccgaccaagtatcatcttcatttgaaatggacatgatggtttcagattgaatattcaaaagagcacgaatcctattattaaaagaaaaatcttcatacatattttcttgtgacgtattgtcccaaaagtcatatgtatcggaatcagatgtattacacactttctttaaaattgaattcgtaaaacgtgactcctctaaccctttgcgctctaatagacgagagcatattttatcttgatattgcttttcatgcatattcatatataaaacagtatcaccaccatacataaatgcaggcacccaccagttatctaaaatcaccaattcatctctattataaagcattctgaacgcatcaaatccaatacactcaatcatttcctctattgaatctgttctaataaaaagtttatcgtgcgtcaaaagtgcagaaataatcctatccaggaaatacaatttttcaggcatagaaatttcaggaaacacatgaccatgccagcgatcataatagaaaccgtcaggagttttgtttactctataactaaatgcatcaaacaatacgcccatatttgattacctattttctgatgaatatacaacttttggaatattatacaaattgcttccagcaaaaaaaaccatggtacaactcattgactggtatagttagtattattacaatacatattggaacgtagtatatcatattctgacttttgggtcacaattatttattcaaccatgtttctatcagtaaccataatttattttctaccagcaataacagaaataacctcgtaagtttcgattacgaggctatctctactatgttctctttttcaacttttggtgtaagattatttctcgttctgcttatctgtcaaaaaaagagcatagaaagaatcttttatcaaataaactccagctagagccattaatcctaaataaataggagctgcggacattccacctcccccttctgaactgtaatcattagtccagtttgacgacaaatctcgcaacatagagaaatcagtaccagcatcaaagagttgaagaacaaatgcaaatactcctagcacaggaggtaacaagaaaaatagaccaacaatacattccacttttttggccttaataacagctttatccatatcgttgaaatttatattaatactccgtttttatgtttcggaaagggttgttccaatccagttacaaaagtacaaaaaatccgtgatatgtcattaaccatcatggactttattttgatttacaatttaatacctctgttctgtctcgacttcggtattccgatggcttctctaaactcattcattttctttctaaaccagctcacgtgtgaaaccccgtctatattgaaatcgaatttaccgctttcatcctgtttgatggagcagacagagtgtcgagtatcaaaacttcggttaaattcggaagaatagagttcaccttttatcccgacctccttgaattcgcacagtcttctgattattccgtcattgaacttcaatcggtcacgcaggaagtttattataggcatcagcttctccacatacgggaaataacatctgacaaaatccgtaaactccgacagcttgcggtgctgttgctcgtaagcgtttcttatctcctgtatctgttcggcttgttgccgttcccgttgtcgggcttcgtcttcaagttcaaggatgcggtcttgcaagtcctcgttcctgcgttccaacgatttcattcttccacttccgaaaagagaacccacactgcttgcaagggcggttgccgtatcggtggctacgcttttgagcttatcggtgcggatttccgcttttacctgtttcagttcctcctgcgcctcggctttcttctcctgtaacagtctggtttcggtttcaagggtttcatttttctttttcaagtcccgataatactgcatggtggtggtgtgccgtgcttccgagccccgtaccccacgttgcaatccgtatttcgtcatcacccttgcgtaattgtcgtggtaggcaatcagagtctggcggttgaacaggtcgtcggcacacaaacggacggaatttgttttcttgcggtacttgcgcttaccgtccgtctgttctttcttggctttgcgcctttcacccgtcacgataggaacaacggctgcgtggatgtgcggagtcttctcgtccatgtgcagatgtgcggcaaccacattgtctttgccgaatgtggcttgcagccattggatactgtcgttgcaccattcgtcaagctttcctttttcctgtatgttcatcatgtcctcgtgcgtacccgacaaaaccacccgaacgacacggacttggtcgtgcgtgattttccgtctgatgcctgccgtgttcagcctgtgggcaatcgctccatccctgccgtgaacgccatcagggtattcgacaagcaccctgttcagatgtgttcttgtcgggtctgcgtttttaggtattatctttctctctatatggtcggactgcgtggtgtccgatgtaccctttgccttcttaatgtccaatgaaaaatatcccatatcattactgtttttgcggttatcgttatgtttcttctctctgcctgtggcatcggctcacagggtttattatgcaaatgaaccattgcagcactcggcataatccaaacgagtttggcttctgccctcgtttgcacagggtttccaaagggatttccctttggctcgatagggtgtttttagcgttacggagtaatgcgtgaagaaaacgccctattgagctatggtatttctgtctaaataccttgggagagcggacgtgcatattacagatgaaatccccctttctttttcggtggctgcatcatccgccttgcggattggacttgcttcttctcctttatcggctctgccgattgggacaagggcttaccgcacaggtagtcgttcaagtccttataatcacgatagtacattgacttgtcaagcatccgttccccgaacttctctttcagcttcttgcaggtgctccgtccagccgtgtcgttgtcaaggaaacagccgatttgggtgtaggtttccaataagctttccgctttcgcaagattggaaacggaattcagtatgacatagtcctgtgtgtccaatcgcgggtgttgcggattgtttcttactcggatggtaaggaatgagaggtaatccatgaacccctcgaacaggtaacacatacatcgttgtccgtcctgctgtcggatatgggtgatgtctttcggggcgacacatcccttgaagtatctgttgcgcacttcatatcctcctgccatgttcggaaagccgatggcaaaatagggtttgtcggcattcataaaccgaagctccctgcattctcttttggcaagtccgatgtttattcccctttcttgcagataggctataagagcaggagaggacaactcaccaacccttaatccctgataaggctgattgtcagaatgctgtctgccaaaagagaacgatgcagggcggatgtatgctgtccgctcctctatgcgtttcagcagataggctacatcttccgaatagtaaagttccgctgccaatgcgaggatgtttccgcctttgccgatgccgaagtcataccatttttcaagctcagtgtttaccttgaacgatgcgtccgtttcttcccgtagcggtgatttataccacaggttcttgccttgttgctttacaggcgtatagcccagactttgcagatagtctgccagtttgatttgctttacatcttggattgtcatattacatacggttttgaagttgatgaaaatttgttgatttgatgaattgtcaatgtaatatatttatatacagcctcgtaacctctcaacatcttctcaacaaaccactcgccaaaagagaaatcaacaaacgggtgtcggtggtctctcaacttctcttttggcttgttgagattttgttgagaatgtatatcgtttattgtcagtgtatttatacccatattcaacaattcaacagaaaaatgataatattacagggattcaagttgctcccttgtgacggtgtagaagcgtcccactctccttatcggctcataccgacactcccgattgcagttgaacaggtaggtggtataagtcagtccgtttggcgcaggggtcagtttccaacattcctgcaacacttttcggacttggtgtttctccacctttacctgtgagtgtaccagcaaaagaagaatgtcactgtaacagaaagagaatgtatccgtgccgacactgtccatgatgtcaaggacaagttcgtgcatctctatctccaaccggttacggttgctgcggataatcttctgcaaggcttctgtatgcagcaatgtggggttgaaccacatccggctttccttattggtggatagctgtctgtgttgcaggaaatgaagaaaggcgggtatctccgctttcagcttttgcaggaagtcggtgtcatcggactgcaagcggtctatcttgcgcacccaatagcgtgtttcccctgcgtctatgattacgggcagatactcgttgttggaacacagcacgaatttggcgaagaacgcaatctcgtcacggtctttgcctttggcttccaccttataggaaagtgtggtgctgaggttcttcaaccgctcgctatcctccctgcggttgagcagcacctcatccaccacgataagcaacttgccagcccagtcggaattgaactggctgcggaaatcctcgttggtgttgaaagtcacattgttctgaaaaagggctttcagaaagttcaggaaggtgcttttgcccgtgttgcgttcttccgacaccaacagcaggataggcaacttctgaatcggttgcaggtagagcagttgcagatagtccatccccaactcgtactgttccccgaagatgtgccgtaccaaagattggatatgcgataaatcgccctcctgcggtcggtggtctatcggttcgtagaggttaaggaacttgccgaccacggaacggtagccgatgtgttcgggtacggtgcagaagccgtcatacttgggaacgctgccgatgtaatccttgccgtaatcctgtcgcagggtctcgttgttccatgcgatgcgtttcttcatataccctccgttcagtctcggttgctccacaatcttgtagagcgttgtcccgacacggataaattcttcgtttgccatgccaccatctgatggcagcttatggcttaatgttactttgttagcttccattttcaaatacttttaggttcaaaaaatgtcagctacaaaaatataagtaattgacggataagttgctacgcaaatcatagcagaatagtgaataaagtactatgggaagatgaatttgatgtgtgctataaactcaagacaattataaacgaaagaaattctctcatttggtttatttcgagtacctttgcggtataattagtttgaatagttagtatatggtagaatacacaagtagtagattatgtttcaaggctgatttgattgagcctttgaatgataatgattcatttattgtgcatattccagatggaacattcaagtttacaaaagctgatttctatcgtgtcttttcaaatattattgaaaccaaaagctatcaagagggcagattgtatagttgtaaatatcctcccaaacgagctatgcaatttttaatatcgggacaacctacaccatataggcagtcagaaagatgtatgcccacaaaagatttggtagggaaagaaatccgaatgaaaattaaggagataggtacattgtggcgtaattctcctaataaccctcagatagatgttgaagtacttgaaaattggaataatctgatagaggaatggattgcagacaaagatatgccattgattattcgcaaagaaacaaacaaacgaggtcaatcctttgtgcatccctgtggaagagagattatcgtttcagataataccgtagctatttgggtgtataataatgttctaaaagggatagtgttcaccttatctcaaatcaaagagctgttgagccaaaaagagttaccaatggtgtttatggcaacaaaagaaattaaggcaaatgccaagtacaccaaaccattaggtagttatgctttgcctaattggaaattgtgtcatattcaacctgtgggatttaatactaatacaagcattgaagatttggaaatttccgatattgaagaccattttcgaaaatatgtaaatccgaacaatatgttcgtacttcctaaagaaattggttatttaggagaaatagatgtatttatagaggagcaaaaacgataaaagataaatagcaggtgttcattacgttcctactatttatctaatctacaatctactacatatcatttgaagaattgacaagcgaaaggagatagcatactttctcttttcgcaggtacagtctttcaagaacggcattacgtacccgttccgctccgaatgtgccgatatggaaagcaagggctactatcgcttcaaggttgtaaacctccatactgcaattatcggattcccgtatgcttcgccttatcccgtattcccttaaaattccgctcttgcaaagagccttcagccctgcacggaatgtcggggcggttactccgaacaggtcgcaaagttcccattcgctcatggcggttgcgctaatgtcggtcggcaaggtgatgttgccgttgccgtccgttgtgatgatgcttcgtttcatggctatgcttggttatggggttacacttccgaacgatgcgttcagcttgttgccgaacatcgtcaggtcattgtcaagtttctgcgtggttatcttcgcatagatttgagtcgtgacaatgttcgtgtgtcccagaacacggctcacgctttcaatgggcatccccttgctaagagccagtgttccaaacgtatgacgtgcgcaatggtaggagatttgcttctctattccgcattctgccattacctttttcagctgtttgcacatcgtccaatagttgattttcccgaaaaccagcctgtcttccgacagatacttgtaccgttcgattatctgcaagggaatatccagcaacttcacttggaacgggacatttgtcttgtgccgtttcgacaatatccatttctcaccgttcacctccactatttcatcagttgcgagttctttcatatccacgaaagacaaggcggtgaagcaggcgaaaatgaacagatcccgcaccaatgcgagggtggggttgtcaaactcgtgcgccatgattcttttgatttcgtcctctgtcagatactcccgttccttaacattcgggctgatatggaactgcgcaaacggatttctcggtatcagtccgttatagtgcgcacgcataaccacgcctttcagccacatgcagttcagccagatggtggcgtttttcagtccccgttcagccgtaagataagccgcaaactccttgatgaagtcgggtgtaagttccagcatggacatgtctgtccgtttgtagaatgacttgataaaggctgcgacatagttccttgcccttaccatgaccttgtatgtgccgatgctgcggtctttaccgacacgtttcagaaagttggcgcaatccttgtcaaaagcctttatcagtgtctcatactcgcttcctaccccttggtaggcattgcgcaccatttcagccgttacgtatgcctctcggtcggatatgcgctgatagtgcttgatgatttgcgccttgatgttgtccaatgccagattgatgttccgtgcttcggcactcttgcctttggctcggttgcctttcgcatcccaaagggttttcgggatggtctgcttgcaactgaactgcgccacagtaccgttgattgtcactcgtcccatgatggggacaataccgtctttctccttgctgctgttcacgtagaacagcactttgaatgtacttcttgccatactcgttttttttgtttgcaaagttaaatatcaacgagttagaccttgatacgcaaatcggtgacaaacggtgcaatagcatctctcatatgttaaatcttactctttcacgggtaatgatttgcaaaccattcttcttcttaaatccgcttttctttgcgttttccgatttttcggcttgtcatcatttgacaccgtaactactctgacattaagtcatttagcgtcatttttcccgtttttcgaggttattccagagattttgcgtaactttgcaaaaagaaccatagataaacgatgaataaaaagattttaatcgcaattttaataagtatcgcccttccgggtagtatgctgtccgcacctgccgacagcctccggctgaaaagctacaagcttgatgaagtcgtggtgaccgggacaagaaatgaaacagacatccgccacctgccaatgaccatctccgtagtgggtcgtcggcaactggaacagacctaccagccctccatcctgcctacactgaccgagcaggtgcccggacttttcaccacaagccgcggcatcatgggctacggcgtatccacgggagccgcaggaggcatgagcctgcgcggtataggcgccggagtaaacgcagccggaggacctacgaccagcctgctggtgctgatagacggacatccgcaatacatgggcctgatggggcatcccatcgccgacgcctaccagagcatgatggccgaacgggtggaagtgctgcgcggtcccgcctccgtcctctatgggtccaatgcaatgggcggggttatcaacatcgtcacccgcaagatgcaggaggacggggtgaaaaccaatgcgcagataggatacggttcctacaacaccctgcagacggaagtctccaaccgcgtaaggaaagggcgtttcagcagcgtggtgaccggctcgtacaaccgtaccgacggacaccgtgacgatatggaatttgagcagtatggcggctatgccaaactgggatacgacttcagcgacacctggaagctgtggggcgacgtgaacatcacccgcttcaacgcctccaatcccggcgaagccgacaatccgtatatagacaacgactcgcgcatcacacgcggcatgacctccttcgcactggaaaatcgttacgaccgcacttccggcgccgtgagcttcttctacaactggggccggcacaagattaatgacggctaccaccccggaggagagccccagaagtcgcacttcaactccaaagaccggatgctgggcatatcctggtatcaaagtgccacgctcttcaccggcaaccgcctgaccgtaggtttcgattaccagcacttcggcggagagtcctggaacaaggttgtcgccatcgacgaggcaaaacccggacagcagattggcgaccatatccccggtgtggacaagcagatggatgaatttgcaggctatgtggatttcaggcaggacatcaacagatggctttcactggacgccggtgtccgcatagaccaccattcgcacgtaggcacggaatggattccccaagggggactggctttccatctgccccggcaggcggaactgaaagcaatggtgagcaaaggattccgtaaccccaccatccgggagatgtacatgttccctccacagaaccccgatttgaaagcggagagcctgatgaactatgaactctcctttacggggcagcttttgggaggggccatgtcctatggggtgaacctctactacatcaacggggacaacatcatcatgacagaccctgccctgcgcaagaacgtcaactccggagagatagagaactggggcgtggaaaccaaccttggctaccgcatcaaccgacactggcagatgaatgccaattatagctggctgcacatggagaatccggtactggcagctcccgagcacaaactctatgccggtgcggactttacgcaaggacgttggggcctatctaccggtatacaatacgtgaagggtctccatacctcggtcaccccgggtaaggagaagcaggaaagcttcgtactctggaacctgcgtgccaactaccgtctgtgcagttttgccgacgtctttgtcaagggcgaaaacctgctggcacaacgctatgaaatcaatgcaggcttccccatgccgaaagccacggtgatgggaggcgtaaatatcaacttttaatactgtcgcgaaggagtatactccgcccgatagatatggtcgaagaatggtgcccactcattgtccgtgatgccaatctgcagaccgtagaagtgtgtaccggcttcccgacaacggcgaatctcctccataaaggcaggtgaagaatgaggaatcttgaagtcgctgacccaaagcacatcggcattcatatactccttgccttctttgagcaggcggaacgtggcttccagcatgcaggtggcatctgtatccccgcaagctgtctttgagaagaattcgagcagccttgcccgctctttccttacatcaatcggatggatggagacggaaaaggctatcagaaagcagttccgccgttgacggtcggctatctccaggagctttatcagcagagagtgagcaatcttctccggcttgccagccatgcttcccgaggtgtccagacagacaatcatcggacctttgggacgggcgggcttggtttcgatacgccgggcaggctgcatgatttccgatttataacggaaggtctggagcttgcgagtaaggtatttgtagacgaacaaatcttccagttcactgtcggcggaatgggcaagctcaatgggaagcagagcattgaggtcgttgccggtgctgatgcccaggatgtcacatttggaggagtgctccattttgtagacgtttccctcggcaacgcggatttgctcacgtccttcgttgtctgccatacgccccatcttgtgggtcactttcactatctcggggcaggagcgctggatgcgcacgattttccgtatacgctcaaagtcgacggtattccacaagccgctcatcatgccccaggtctggaagaattcgtccttatccacgcggttctggcggatgtactcggggatgtctttcagattggaacggagcctgcgctcgagggcatctttgcggaaagcaatctctttctccttttcttcgtgcatcttcagctggaaggcgtcttcccagtcgtccaccattttctcccagacttcatcgtccgcatatcctccttcggtaccgaagtggctgcgatagaagcgggagtcgaagccgtactcccggtatttgtcggaaatctgctgaagcaaggcttgccagccgtctttccgctttgccatggaccactccagcacgagtttcatctcatttcgttccgactggcttttccggaggttgtacctctccttctccaaattcaagtggataaactgaatcatggtgtcgtaaaagatacgtgcacagacctcattgcccagcacctgcaccttgaccatggagtcgttcatcacggagagcagataggcatacaagggctcggtatccgtctcagcacactctccggtggctacaaaacggtccagtgcctgcacatagaaggcggtgtcatatcgggtggcggtggtgttcatcttcttcttggttactggaggattattcgtctccatatctcagtttgcgcatgtccacacgcgcccaggctatctccttgcggacgatggagacgtattgagctacgctctttttatcctcttcggagacgaaaaggttggcggacaaatctcttaccagccggtctatgctggtggcggcggtatccagttccgtctcgtaatcacggtcggtgacggagaggtttcccagccagagttgttgctcctcgccccgttgcagacgccgcatggggaagcacacaccgttgatgtagagatgcttgtcgtcgcggtagagggtgacgcgttcggtgccttcctctttcacggcgccggtgtcggcaaaggcacggatgattgtacgcttgggattgagggggtcggcatacattatacccaaggtgggggcatctttggtgctatactccttcagatttttgtagtccacgataaagatgtaggtgttgcccgtaccatgtttctccacctggtagtagaagtggtccgttatctgcaggtcatcgtccctacggtcgccggcaaggcgggctttgtcgagggcttcgcgcacacggctgactttcaaatcggatttcagcgaggaggcgataccggcaatctgttttgtgtgggacacgaataaggcacggataacaatgtcacggatggcaacgctctcatcaggctcactccataggcagtggtagacgggaagcaagtcggtcatggagacttccgtgcggccgtggacgaaggcggaggtcttgagcagcttcacgatgttcttccagcggcgatcgctgacatagacattgcggcgcaggtcggagtcttgcatctctacgcttgtcagtccgtggcgaatggctgtgatgcaggaaagaacatcgagaggcaaggttacgcggcgtatctctgcttgccattcggcatactcgcggtcggagatttgccattcgcaggcagtcgtttccggatggtcagcagaatcgtccagcagcattttgtagaaagactcttcctgcttgacgcaggtgcagagaatgcggatgaggaagcggtcccatagggcttccagtccctcgccttgggcaggcagttcgttgctggcagctacgagcagtttgagggggagatgcagttccttgtcgccgttgcggaaaagtttctcgttgatgacggtcagcagagtgttctgtatggcagggcctgctttccatatttcatccagaaacacgacgtcggctgtgggcagatagccgtcgatggcacgttcgtacttatcggattctttcagccggctgatgctgacgggaccgaatatctcgtcgggtgtagagaatcgggacatcaagtattcgaaggcacgggcatctgtaaaagcagactttagccgcctggctaccattgacttggctactcccggaggccccaggagcaggatgctctcacctgccagggctgccagcagggagaggtttatttcggtttctttttcgtatactccccggttcatttcggaaaggaggaggcggatgcgttggatcatttccacaatatgatttatttatagtcagtactcatgtataaagaaaagtgtgtaaagataccaaatagtagcgaaatcagagagattcttattaagattcactatttttggaaaacaaatacacacacagacacgcacacacacgttgtgatctgctttcattttagtatctttgacccattggaaacagcgataggaatatacgtgaaattgaaacaatagttgtgatttgctttcattttagtatctttgaaccattggaaacagcatcttcggacaggcattcgaactgccttctgttgtgatttgctttcattttagtatctttgaaccattggaaacagctggaacccatatatacattgccgggaatcagttgtgatttgctttcattttagtatctttgaaccattggaaacagcttaacctttgcaatttgtatatatcaaactgttgtgatttgctttcattttagtatctttgaaccattggaaacagcttatgaaacgaatatcgttactttaacgttgttgtgatttgctttcattttagtatctttgaaccattggaaacagcgaatttgcatacatagacgtgtacggaaagttgtgatttgctttcattttagtatctttgaaccattggaaacagctcataggaagagcttccataccgatattggttgtgatttgctttcattttagtatctttgaaccattggaaacagcatacattgattttaaaaacaacacaaaggtgttgtgatttgctttcattttagtatctttgaaccattggaaacagcatttctcgcaatcttgacattagtgaggttgttgtgatttgctttcattttagtatctttgaaccattggaaacagcaggagtaacgatgataaccaaaggcggtaagttgtgatttgctttcattttagtatctttgaaccattggaaacagctatgtgattttataaataaaaagtccgttgttgtgatttgctttcattttagtatctttgaaccattggaaacagcgcaacaaagggtacggcgtccacaatcccgttgtgatttgctttcattttagtatctttgaaccattggaaacagcacgtttgcgccaatctttcgggctgaaattgttgtgatttgctttcattttagtatctttgaaccattggaaacagcggtcaacggtcaacatttgtaccgggttccgttgtgatttgctttcattttagtatctttgaaccattggaaacagcaacgacgttagaacgaatttaaaacagcatgttgtgatttgctttcattttagtatctttgaaccattggaaacagcgtttcatcgcccacctatagacaattttaggttgtgatttgctttcattttagtatctttgaaccattggaaacagcccaatttgttgccattgtcgcccaaacaaagttgtgatttgctttcattttagtatctttgaaccattggaaacagcgaaacgaggttataccacaaaggacgggcggttgtgatttgctttcattttagtatctttgaaccattggaaacagccggttacgaccgttatgttgatattgaggcgttgtgatttgctttcattttagtatctttgaaccattggaaacagcaaaccatgatacaccaaagaatgagattaagttgtgatttgctttcattttagtatctttgaaccattggaaacagcataagcttgtggtggctgctggcagacctagttgtgatttgctttcattttagtatctttgaaccattggaaacagcaacgggcttgacttaaattcgtacgtccaagttgtgatttgctttcattttagtatctttgaaccattggaaacagcattggcgatgtaccgagacttcgagaaggagttgtgatttgctttcattttagtatctttgaaccattggaaacagctaaatggtatgcaaagttaaatcagaccatgttgtgatttgctttcattttagtatctttgaaccattggaaacagccgaagatgccaagtagacctctgcggtatcgttgtgatttgctttcattttagtatctttgaaccattggaaacagctttatttaaacacctttttcccatattattgttgtgatttgctttcattttagtatctttgaaccattggaaacagctctatagggctgcccaactggtcaactctggttgtgatttgctttcattttagtatctttgaaccattggaaacagctgattacaagtaacaatctaatattcaaacgattacacatagtattagaatataaaaaaagaatgctgcttctgaaaaaatcccgccattgcgcgggatttttttagaataattctaattgttgtccaggcgtattcacatccacagtctttttcccataaaaaagtgctatatttccaaattgcttgtccgtaatgcacataattccgacacttccatagtccggtaagaaagatttaactctttttatatgtacctccgcattctcacaactcgcacaatgacggacatatatagagaactggaacatcgtaaatccatccttttgcagattttttctaaattccgcatacgcctttttatccttcttggtttcggtaggcaaatcaaacaacactaatacccacataatgcgatattcactaaaccggtccatcacatctctggataggatattttacgcaactcaccactgaaacatttatacagagaagccgtagtctgcccaacagctaccatcaacggactacgttttcccgaaataacagtctctaatgtaggaattgtcagtaacctcgctttcaattctctcgtcaattcaacacaattcggttctgcttccttgaatatatcatataccaacctatccacataagggcgataaggttccattatatcatctgccagacaataagcattataacgattatgatgatgtattcccaaagtaggtagaagcccacttgtcaccaaagcacgagcaacaactgccctcaaaatagcatacccataatttaacaaattattaggaggaataccttctctatcccttgtaaagccttctattttaaacaaattcttccaataataagcagctgcacgagcctccaaattatcagaatctccactctttacatctgcagcccacaccttcatacactttatttcttctccagcacattcatgcaatactaccgtctgattctctattttggcttttattgtttgctgccaaagttgtttcatcaatggtagagacgcaccaagttgatgacgaaacctttcattttgtgtagtattcccatacaaaggaagcattaaaccaaccggcatacttttagaatcgcaggttatgactgcacaattattctcaagcaaagcttccaatactcccgaagtaatggttatctgcttattgtccaacaccactactccaatatcttctattggcttagtcacttcggacattcgtttgaacccttcgggtaaagcactgttcttcaccacctccggcaatttaatcaccaactgggcattttttaaagacaaatagaccggattcccaaaataaagtgttttcttaatcatagcatatagactttacaagttattcattcatcattttcaagaaaaggaagctctaaagtatcattctgtttatcagaatccaacagaaaattttcaggagaaacaacacttctacccaactctttttcagcttgttcacgtgctactccggctacatttcctccacgttgtgctacttgcttacttttagtaaatgtatctggtttttctttctgagaaatttccgttgtgacacgttctccaagcattgtaaatatcaactccaaatcagacatgtggtcacgaagattctgatttttcttcgtcagccccttatatattttataatccgaaggagtcaatccaaacgttgctctagatatttctgccgtaagaatggcataatcacttttttccgtgattcccctttctttccattcatccgtcaaattctgacgaatggcgattcctctcaaacgtttgtcaatccaatcttttggataacctttttgctcatatagttctttcatgcgctcttgagccaattccggattttctatttcctgtacacgctcataacctacttgtgctaaccaaagcttgaaaggttcagctttaggagaaggaatagattgaatgatgcggaataaagcctgcacatttgccgccaacgtttttcgtttttttcctgtatctgtcaccatttctacctggggacaagttgtccccaggtaagtagccagttcttcatcccgttttcgcatcttcttcagataatccgtaggattcacactatcagtcaatacaccaactacatctacaacagagaaataccattgctgttcttcctcgttccatacggaacggatctttttctcttgaaacaactttatattattcatttactctatacttaacttctataatacggcctaacctatcaacttttactggaatacaaatattctttatcatttcaccatcccatgatttttctgctttattattagaacctaattctttagtggaaataatagcatttgatatactttgaggtataaaaaagcattgattaccagaagatgaaaccatcttataaatcctccccctatctatcggttcatttatcctaccaaaatcccgctcttcttcggttggcagatataccaaatcattaggagacagccaaaacaataatttatctcccttttcatttctgtccggtacaggaacaagcccttgtttctcacgctctataacccaatttaaaggaatagtctcatacgttctgtttccatcttctgttatgtaaatagcaaagaacaagttagtacctttagcagcttccacccatttggcacctttattgccaagtacaccgactttaaatttatttccacgcggttcatacaccctcaccttatatataggctgatgtcctttaccatcattcagttgtaaaagattacggttcatttcttctataccttctgcagaaaaagccaactccgcctttccttcttttgatttcagatgattcaggagtattttctgtatgccagtatccgtcaccgatgctatcttcttctcattgaaagttgagtccaatgatttacgtactgcaactaaaggttcagtagtattttccgtaaaataataaacagcgactttggctatatccagctctttccacaagaaagcattctctttgaaatatttttcaattttcttcttatcatacttatatgataacaattcaagaaccttattttttactcttttgtcaacaatcatagaaggagtatccaaagcgacagataggcgtaccacctttacctttcttaaatttaccgctccaaaaaccgtatctttgtgcatcggtttacggatagcccaactatcaccgattttctgtttctcataaacacgagtcccatttgcatcaaaatgttgatagatattggttgttttatttattatacgcaaattctgtttcaagctaactattatcccactcaacgcttcccttgcatcttgcgtaaaagtagtccatggtttctttataatccatctataattaccattaccatcccccctactcttatcacacaacagtctctgcaaatcataacgggaaattttcgcattccggcttgcagactcattattcagatagtttacatgattccgtgtagcacaagctattactattgcatccatagcatgatgccgatggtctatacgcttcttactgaatcctttctgatattcaaggggcactgctgtttgaaaaactttttttccgtctttattctcccaatgtccaaaacactgggtttcggtcaaagcatttaaacgttcaaaacgaggacttacaatactattccagacgtcattcatgccccaatcctttttcagcctgtccgtcacgtttcctgtacaaactaatatgttttttgaaacagcctccggttcatattcaccgctatcattcttttcacgaacgatattcgacaaaagtcctttgacaaccttactgatataccggctatcgtttaattggcgttcaataaattgctcgggaatatcatccatcaacaatttcttcatttttatgcccgattttgcatattgttcttttacaaaacgttcgtaactatccacagaaaagatttctactgtctttccaaaacccacttccactttctgtccatgatgattcttgataaactcatatcccagttgattatctttcaacttgttcacagcagattcacatatcactttgttagagaatgaatcatcaaaatagcgggattgaggtataacatgttctatctcatacgcagcagtaaataatttagccaaaggtatcagctcaccggtataaggtgaacgatatttctgttccagccataatttataacgcaagaattctgatttcgtcggtaatttactggtattgaattttttcaatatcacatctatatcttccggaatctgttcttccccctttaaaactgcatcctcataaatccgcaatatttcttgttgacttggtgaatagggacggacattctctaccccatattccggattcacaaattcagcaagcaatgcctttatacgtaaattggcattttcattctccagaatctgagtagtcattctttttcgcttgtccgcaggatttttcatctcgcgccctaactcaatatggatttcatcaattttcccaacctgtttccaaatatccctgacaactctcaatgtctcggttatcacttgttctacgataggatttcgtagtgaatgttgcttaaaagcagccagataagcatcaatatcagcaggggtttcccatttggttatttctttatcttcggaatgacgattatacactacataacaagccaaccacaacggaagcctcttaaaacaagatatatccgacaagttcatcgccttttctctaaccttggcacctatactctcatcacactcacctgctattatcctttctattctttccttggttgtaccatcaatcaacgacatatcccaatactttccgcacctcatcaaaggcaacaacttctttatcgccttggcagaataagcgccatattcagacttgaaaggaggaaacttcttgaacacttccacaaaggattcattcaatccgttcttaaccgcaaaagtcgccaatgctttctctatttcctgcttgtcacttacagaatataagatatgccacaaggctgtttctttttcatcagataaaaagtcaataccaataccggccttttccaaacgggaaagaatcgcatgtctcgtctcattacatgggtagaacttatcctcgacataattccaacgataattatttatttcctttttcagtccaaacgcaggatatctcagaaaagctttctgatctatttcctttcgagagttcagccaatcaaatagagccacataatcatcttctgttttcaaaaactccgttgtcacatccacatccaaatataaagttccatttacttccctttccttttgatatacccgaatattggaaaggaaatgccataaacggaattcctgaaaaagaggatgtgacttggctatacactttaacggagctgttttgatttcacctgttttgcggtttacatattcattttcctcataagggcaattagctatcaatgactttttggttttcaacggcctttgataaaacaagacatcatctattaacaaatagataaagtcccggttagctatatttctccgttgcacttcattacccggatacaacgcttcaatacacctcatgtataaatctctatcctgcaattctgcatgaaaagcacattgcttctgcaaaatcaagttcagttcctccttgtaaaactttcgttctactgttttcaccaattttcctattatcttttgttgtggctcctgcaacaaagcatcatatatataactcccaatcgttttatgagtaccggcaatgtccgcttcggtccttttctttattaacatccaatcatcctctttaggcgctctgaaagaacgcttcacctcaccatacttatcaagctttggagtaccgtccggatttaagtcagtagtgacaataaactcttttacccatccttcccagtccaatgggacattactgcttctacgatatacccatccattctccagatgtacattataccatatatcccggcctttcttttcatcagtcgcttccaccgacaagactttcaatgcataaaattcaacagattttcctgcattgtcttcctcctcttctcctctaagctgataataaccacgtttctgattaaagttcaaaagaatccatgccagttcttctttacttatcatttctgtcaaagctttcttacggagataataaactgtccagtcataagggatttttttaccatcaaaaaccaatgaaggttggtgctttgcaaaatccgccaacatttcattaaacgctgtctgaaataaaaaagagtattttccccatctatcctttacccatggcaatttcggttcgctgcctgacaagaatttacccgtatgcttttcaaaatctattccttttaaatagtgttccggcaggaagccaagaatcttcaaaactttatgcaaccgttcacggcgtagtaattgtcgctctctcaatcgacgcacccctctaaaacgggttctttcagctgtctgtgatatagaattccctttgtcaaagtctcccaagatagcagcatccatcggaattattctactgccagccatttctatccaaattttctcggtctgttctttaattacagagtttattacagcccatcctatactattggttcccaaatccaatccaagtatcgttctcatagtattatattttgaatattttcttcaaaggtattttttttttcaatataagcattgtatttccatatttattttatacatttgtcatactaaaatgaagcaagtcacaataaggattattccgttgtgaaaacattaggttccctcgtccttaacgggggattttttatttccaaaaactaattatcatttccaatatcccccttttgccgaaaactaaaactttcctccccaaacactactcttcgtatcactatattttatacctttgttcactaagaaataatcgtcacatacccatttccgtttcgtccgacagctgtcggacgataattaaacaactgttggacgataatgcaacagttatcggacgattagtttttaggaagaagaaaattaatccgcttagcgacaaaaataattccccgaagcgacgagaactgtttatcgctataaacaaaaataaatatcttatgagcgcgtattacgacctttacgaaacgccttcgcccgacgggaaagaagacaagaaatcactccacgcacgtatctgcccgaaaaggacttatacccaaaaggagtttgtggaacatatcgcaactttccaacatctgcccaagaatgtgataggggcagcattggatgcctgcattgacgagttgtgcgacctccttgccaacggaaacatcgtggagctgggagaactcggattcttcagcacttcactgaaatgcttgcgcgaaaccgacgacgagaaaaagaaaatccgctccgaatccgtccaattccaaaacgtacacctgcgcatcagcagcacgttccgcaacaacatcaagaagaaaatgacgttggaacgtgtacactccactaccaagaaatcgaaaaaagtagtagagaccaccgaagaaacaagaaaagccgaactggaactgttcctcaagcagaatgtatgtatcaacaagaacgaatacatccaattgagcggactgaccagacatgccgccatagacgaactgaacaacttcatccggcaagggttcctgcgccgccgcggaatgggaaggtcaacggtctatgtacgacaagaaaaagacacagcaaacgaaatttaggggggggggcgaacacagagacacaaagacatagaaattaatgctttatctctttgaaaagaatctctgtgcctttgtattttcgtgttcatcccccaaaaaataataaaacaacaaacaatggaaaaatcaacagaaccccaaccctgcactcagtggttcgtcttcttcaaagaccaactgctactgaaaaaaggatatacagacaaaggagaaataaaatacagcgtacccgtcagtatagagcctcctctgacaccggaagccggaagtaatatacacgaagtgttcccccccaacggcaagcaagtacgtgcatttgccctgaaacagcctgtgaccgagagcgacgaatgggtaatgataggcctgcgcgcatcgtacgactacatcaccccggacgaataccgttccgcaggaaaggccttccagatactctattgggacgagcacagccgcttctgccccgtgtgtggcaccgccatggagcaccagacccccatcatgaagaagtgtcccaactgcggcaatgagatgtaccctcccgtttccaccgccatcatcgtactaatacgcaaaggaaacgaaatcctgctggtgcatgcacgcaatttccgcgggaccttctacggactggtggcaggtttcctcgaagccggcgaaacactggaagaatgtgtggaacgggaagtttttgaggaaacggggctgaaggtaaagaacatcacctacttcagcaaccagccctggccctaccccagcggattgatggtgggtttcattgccgactacgaaagcggagagataaaactgcaggaagatgagctgaccgctgccgccttctattccaaagacaacctgcccgaaataccacgaaagctgagtatcgcaagaaggctgatagactggtggatggagaacaattaaaaattaaagaattaaaaagaggggggaagaaatttaaaaaagcaaattgcggaaaacacacactcacaaacgaacaactacgaatgaaacgactctcattcacatcaaccaatcggtgtgtaaccgcaatctgcatatactaaacttccctgcaaacgttttgttcatcaaccatcgggtttaagtctttatttaagttttctttcaacacagaagcaaaaagaaaaggcgcagccctcacgggttacgcctctccaaacactatatacacattttttcctctttcctatcaaatgccgagtgacttgcgcactgcctccactttcttttcagcttcggcatcagcgccggcatagcatttcggacaacccatctcgcccttcacctcgatatagaacttaatcttcggttccgtaccggaaggacggacagaaatcttcgtgccgtctacagtgaaatattgaagtacattggaagtctcgggcatatccagcttgcttacattaccccggacatcggtagcctccaatgtcttgtaatccttaatcaagctgacagccgaaccgccgatttccttcggaggattggcacggaagttatccatcatcgccttgatttcttcggcaccgctcttaccgggtttcaccacgttcacggtggtttcctttgagaatccgtattctacatagatttccatcaatacgtcatagagtgtcttgccctggtctttggcccaagcacagatttcggccagcaaggagcaggcagaaaccgcatctttatcacggacaaagtcttcggccaggaagccatagctttcttcaccaccaccgatatactgctgcttgccttcgctcagacggatttcgcgggcaatccacttgaagccggtatagcaatcgcgcatttcaatcttgttcttatctgccacagccttgatgagttcagtggtcacgatggtcttcacgatgaagtcattcggctgcatcttgcccattgcaatacggttcttgatgatgtagtacaagaaaatgagacaagtctggttaccattaataagcacccactcgcccttatcgtccttgcaggccataccgacacggtcggcatccgggtcacttgccatcacgatgtcagcgtcaatcttcttggccagcgcaatggccatggaaagggcttcggcattttcgggattcggagaaaccaccgtcgggaaattgccgtccttcaccatctgttcgggcacgcagttgatattctcaaatccccactccttcaatgagtccggaatgagcacgcggcctgcgccatgaagcggagtatacacaatgctgaggtctttctggcgacggatgacttcggggtcaatggagatggagtgaaccatgtccagataaaccttatccacttccttgccgataatctgaatcaagtccttgttgccgttgaacttgatgtcggtcaccgtcaccttattcacctcgtctatgatggctgtatcgtgcggagcgagcacctgcgcaccgtcatcccaataagccttgtagccgttgtattctctggggttgtggctggctgtaatgttgataccgctctggcaaccgaagtggcgaatggcaaatgaaacttcgggcgtaggacgaaggtcatcaaaaagatataccttgatgccgtttgcagagaagatgtcggcagaaatctttgcgaacttgtcgctattgttgcggcagtcgtgccccacaacaacggaaatatccttctttccggcaaaacatttgttcagatagttggacaagccctgcgttgcggcacctacggtgtagatgttcatgcggtttgtaccggcacccatgatgccacgcagaccacccgttccaaactccaggtctttgtaaaaactgtctatcaattcggttttatctggattttccaacatgcgtttcacttctgcctgagtttcggcatcatatgccggggtaagccatttttcggctttctcagtcacctgcttaatcagttcctgattttccataagactgttattattttaagggttaatataaacttttttgtaagacacaaatgtagaagaataagttcaaatatcctaattttattcaggcattttatatctgtctcccgtctgcttaacatactcttcaaggaactccttcgggtatcccgggcggattacgcctgccggctggccaatggaattacgttcgaattgaccgtttttcatacgtttgacaacgccgtcattatactttacgacaagaaactcgccaagacgtttccaagtatcgaaggtactttgagcggtcatgttcgtatagttggtaagaaatgcctttgctttggcaggatctttttccagcagtttggcagcagcagcctcaacgccttcctgcgcttcgttgaaggttgtctccaactctgtctgagtggcacgcacgtcgcccatcatcaagtcataacggggataaaccatattggccacccagttgaaaatccagaaagcggagttccaggagaaagtgatgtaatcggcgccgtccacacgggtgtagcatacgggaaccttgtccgtacagcagtatacaggtgtaaataccgtcatattggcatcatccgtgccgaaccacaatactccaccgatagggtcgggcaactcggaacgcatctgtgccacgaatacgaaaccgctctgctgggtggagatgggacgctcattgaagtattcctggtcacccaccttgaaagagagtggagaaaggcggtacggggtatgatacgggcctgcgccgaaatctttgctgatgtcgagaggagtaccttcataatggtcgcgcatggcgttcttcacatcctgcacggaaaccttgcggttgggcttcacaaacagaggcatcggagtgtccgtctcacccaatatataaggcaggaactcgttgccgcggtcggtaaacatattaaaatagctccatacgcgtgcctcgcaatagcgacgggcaccgaaatcgagcggagcgtaggcatcggcaaagctgaaatccttgttcacaccgtcaaaatagcccttctcgcgtgcaaaagagatgacgtcggcagagtacatgcagttttccttgtcattcatattgaactgatgaatgcggctctgattggcatgtgcggagatacaatcatcgggcacgcggacagctacccatacggcaccgcgcacaccgggtcccttgccaatcatctccataatccatatctcgttggggtcggcaatggtgaaggattctccactactgtaatagccatattcctgcaccaattccgtcatcaccttgatagcctcgcgagcagtgcgtgaacgttgcagtccgagataaatcaagctaccgtagtcgataataccggtagtgtctaccagttcggggcgtccgccgaatgtcgtttcaccgatagtgagctggaattcgttcatattgccgatgacattgtacgtctgacgcgcctgctctatctgcccaaggtatttgccggtgtcccactcgtgtatgtcaatcagcgtacctttcttgtgcataccggcagaataatgatacaactcgccgaacaaaccataagaatcggcagaataggaaacaatggtagaaccatccgcagaagcgttcttgcccacgataagattggtgcaggccagcgcattcgccacggctgccacaacaaacaagacggaaagagtcagtcttttacttttcatacttctaaattataatgttactaaatatttcagtctttaccatacaaaatcaaactgttcggtggtacggttgccacagccatccgtcaccgtcatctccaccacgtgcttgccgcctttctccacatgtttcgggtcgagctcgcacaccaggttaccgctgatggaattgggctttccaaacaaggcatacttcccgtcaatcgtaccccgataggtattgatgccggtttccttgtccttggccttgaagatgatttttcccgtacgtccccattgggcttggtttacgggagttatcaccggcggaaccgtatccaccgctacggtataagtccccaaatcccgtatacgcactttcatgacaccatcctcatacttaccgccgatgcggtattttccaccgcgcgccgttacgcccgccacataatatttggtcatatcctctaccggacgccggcgcaagccgatacgcaaatcgcaggcaccgtgcataggaatacgggtatcgttcaattgataggtgaaagcgatgtcgccactatcagcccgcacggagtagttcagcaagacgtcatcgtagagcattcctttcgggataaccaactccagccccggctcctgcagatagttcaccttatcccatttgagggcgtatttctcacgatgttccaccggagcaattatcgtcttctgtccctgcactgtgaagcggaccttggagatatttcccagcgcatctctcagcgtatagacaaaccggtaagggtgttcttcgttgatgtccaccagtccgcgattgccgttggatgcctgtagcatgcgcaagtggttgcccggctctataaaagacttcatgtactggccgtgtgtccacgaattgatatagcggttctcctcataggcaaagcgatctaccgtactgcggaagacttcctcgccgtccacttcgagaatcaccgccttcacgccatatttattctgcactccgtccatatagtcgtaggcacggatacctgcaccaatcagtccccaggcggtaatgggttttgttggatgtgccggaaaagcccgtcgcgtctgcttgccctccaccactccttttcccggctgtggaaacagcatgataccttcggcacgcggggcagtcttgtctttcaccttgttcatgaagaaaggcaacgggtctatatattcgtccgtagccgtctctatcatatccagatgcaggtgcggaccgaaagagtaaccggtgtttccgcttaaagctattatctgaccggccttcacgggatattcatcggggtcgggagttatttccacctcccagctttctttttcatattgtaaatcttctatccgacgggcaatgtcacccacaaaagcactcaaatggcggtttatcgtcgaatagccgttgtcataagttacatcgagcacataacctgagccgtgggtgacgcggatacgcgaaatatatccgtctgccagagcgcgtaccggcttgcctatggtgccacctgtcttgaaatccagtccgccatgaaaatggttggcacgtatctcgccgaagttaccggagaaagtgatgggaaaatcaaaaggcgggatgaaggaaggcttgtctgtatcggtttcttgggcatagccgctttgcacactaccaataaagaacaaaagagagaaaaatatagaatatttcatattttgtacagtcaatattattttaaatgcatgcaaatataaaaagaatagttctctctacctacagaaagctacaattatcattgattaaaacatgcataaaaattctgttgaagaacatagatgcaccgataacacccaagccgggaaatcgctatattgcgccatgtttaaccccccaattaaaactttaaggttatgattatcggagtacctaaagaaatcaagaacaacgagaaccgcgtgggaatgacccctgccggagtagccgaattggtgaaaaaaggtcatacggtgtatgtgcaggccacagcaggcgtaaacagcggtttctccgacgatgactacatcgccgtaggtgcaaagactttaccgaccattgaagacacgtatgccgcagccgacatgattgtcaaggtaaaggaacctattgcaccggagtacaaactgattaaaaagggacaagtggtattcacctatttccactttgcagccgataaattactaaccgaagccatgattgaaagcggtgccgtctgcattgcctacgaaaccgtggaaaaagaagaccactcacttccgctacttactcctatgagtgaggtggcaggacgcatggctacacaagtaggagcccgcttccttgaaaagccacaaggcggcaagggaaaactgatgggcggagtaacgggcgtacgtcccgcacgcgtacttatccttggaggtggtatcgtgggcaccaatgccgcacagatagctgccggaatgggtgccgaggtactgattgccgacatcaaccttccccgcctgcgctacctgagtgaagtgatgccgaaaaacgtaaagacactctattcttccacccataacatcaagatggaattgccgaacatcgacttggtaatcggttccgtcctcatccccggtgacaaggccccacacctcatcaccagcgaaatgctgaagatgatgaaacccggtacggtactcgtagacgtagccatcgaccagggcggttgtttcgaaacctcccaccccaccacgcacagcgaccctacctacattgtggacggaattgtacactacgccgttgccaatatccccggcgccgtacccttcacctccaccatggcactgacaaatgccaccctgccctacaccgtagccctggcatgcaaaggctggagacaagcctgcaaggacgacccggctctggcgcagggattgaacgtagtggaaggcaaagtaacatacaaagctgtagccgacgtcttcgggctgaaatatgaagccattgagtgataagtgatgagtgatttgttggtgtttttctttcagcatgatagcgcagcacaattaccaacaaatcactcataactcctccccaacaaagaatccttcttcctcgcatactcccaccacatagcgagcagtgtgatgcagaggttgaaaataaacggaaattccctggaattagtgtggaacaaggtctgaaagaaatctgtaatgaacggggacaatagaatcgccagataattcatcaccattacaaaagccagtgccaaagttgttttttccggtatggccgtatctactgtctcgtcataaatcagcggttgaatgacaccatatcccaaaccaaccaacatacatcccgatattatcagccattctttaggcgaaatccatatcaagagcaaacccactgcaatggacaaaaggctgtagaactttgtgtgtttccccatccacttcacgatatgccccaggaagaaacccggagccataatggcaaggaagaataaggagatcatcaatccggaatttccgctggagaagtgatgggcctccatcaaaaaaggcaagtcaaaagtaaccgccagcactatatacgtagtgacgccataaaacagcatcaactgtagcagatggcggatatggatgccgtatttaccgggaaccgcacgcttggattcctccggaacaacggcagccgtatcttctgctatctgcggctgaccggtatcccccttcaaatatccgacaagcagcagagaaaccaacggaagcagatataccacgaaaggcaagtgccagtttacctctgccagatacccagtcaccgccgttgccacaaccagcgtcacattggtgatggcagaactgtaaccaaactgcttcacccgatattcccccgtgaaatagcgtgaaaccagaccggtggacaacggaataatcacccccgaaccgatgccaagcaaagcgctgaccaccatcaactgccacattttgtccgaaaaaagataaagtaccccactggcggcaaacatccaaagtcccgctttcagcagacgcacaaagtcacgtttctcggccagcttgcccgccaacagcacaaaaggaattatcagcagcgaaggcagggaggtaagcatctgtatatccaattccgtggcatgtggaaaaatggtggtaagctgtcccaaaataggtgacacggccaaccccggcaaggaagtcaatgcagagacagaccaaatgccgacaagcgtgattagggggattgtaccccttccggtattgattttcatatagtagtatattaattaaatgaataatgtgggaacaacaaacccaccttcagaatgttcgttttttaagattttactacgctgccctttaataaacgccaaataatgcaaaaccccggaactttcatccgcaaaccccgttgttgtgggatattcgacggggaaaagccccgccgcctaaacctttaaaaaacttattaatatggaagatttgaatttcagaaaaggagatgcaaaaactgaagtattcggctcaaaccgtatgttacaaccctcacccgtagaaaagattcccgacggacctactaccccggaaatcgcctatcagatggtgaaagacgagaccttcgcccaaacgcagcctcgcttgaatctggctacattcgtcactacctatatggacgaatatgccaccaagctgatgaacgaagccatcaacatcaactacatcgacgagaccgaatatccgcgcatcgccgtaatgaacggtaaatgtatcaacatcgtggccaacctctggaactctcctgaaaaagaaacctggaaaaccggcgcacttgctatcggttcctcggaggcatgtatgctgggtggtgtggcagcctggttgcgctggcgcaagaaacgtcaagcacaaggcaaaccgttcgacaaacccaacttcgttatttcaaccggtttccaggtggtatgggaaaaattcgcccaattgtggcagattgaaatgcgtgaagtgcctttgacactcgacaagaccacgctcgaccccgaagaagccttgaagatgtgtgatgagaacaccatctgtatcgtgcctatccaaggtgttacatggacaggactgaacgatgacgtcgaagccctcgacaaagccctcgatgcctacaatgcaaagaccggctacgacattcctatccacgtggatgccgccagcggcggtttcatcctcccgttcctctatcccgaaaagaagtgggacttccgtctgaagtgggtactctccatcagcgtcagcggacataaattcggcctggtttatccggggctgggttgggtttgctggaaaggcaaggaatatctgcccgaagaaatgtcattcagcgtaaactacctcggtgccaacattactcaggtaggcctgaacttctcccgtcctgccgcacagattctgggtcaatattaccagttcatccgtttgggattccagggttacaaggaagtacagtacaactccctgaccatcgccaagtatatccatgacgaaatcggcaagatggctccgttcgtaaactattccgacgaagttgtgaacccgctgttcatctggtacttgaaaccggaatatgcaaaagctgccaaatggactctctatgacctgcaggacaagctgtcacaacacggttggatggtacccgcctatactctgccttcaaagctggaagactatgtcgtaatgcgtgtcgttgttcgccaaggattcagccgcgacatggcagacatgctgctgggtgacatcaagaatgccatcacggagctggagaaactggactacccgactcccacccgtatggcgcaggaaaagaacctgccggtggaaaccaaaatattcaatcacggatgccgtacacataaaaagtaacagctaatatggaaaagaaaatatcaatttcacaaataaaggaggttgcccaagaagcctacaacgaggtgaagggcagtacgggaggcaagaatgcggattatatcccctaccttgccaacatagacaccaaactgttcggactcagcatctgcctgatgaacgggcagaccatcaatataggcgatacagactatcgtttcggtatagagtccgtctcgaaggtacacacagccatccttatcctgcgccaatacggcgcacagaaagtgctggacatgataggtgccgatgccacgggactaccgttcaactccatcatcgccattttgctggaaaacgaccacccttccactccgttagtaaatgccggtgccatttcagcctgttccatggtgcagccagtaggaaactccgacaagaaatgggatgccattgtacagaacattaccgagctatgcggctctgccccgcaactcatcgacgaactgtacaaatcggaaacggctaccaatttcaacaaccgctccattgcctggttgctgaaaaactacaaccgcatctacgatgatccggatatggcactcgacctctatacccgccagtgttctctcggcatcacggcccagcaactgggcattgccgcaggaaccatcgccaataacggtgtgaacccagtcaccaaacaaacggtgttcgaagccagcctggcaccgaaaatcacgtcgatgatttctaccgtaggcttctacgaacattcaggcgactggatgtacaccgccggcataccggccaaaagcggtgtgggcggcggcgtaatggccgtattgcccggtgtcatgggggtatcggccttcgctcctcccctggacgaagcgggaaattccgtaaaggcccaatcggcaattaagttcatcatgaacaagctcggtctgggtgtgttcaacggtgataacgtgacaattacagaataagattttttagttatgagttataagtgatgagttatttgttggtatatgcatcgtaattagcaaataacttataactaataactcataacttcataatggacttcatcatgaaaatggctctatcagaatttgtattgcgggaaaaaggtatttacggcatattacatgtcatcatactgatactttcgttatttttagtcatcagtatctctgtcgacacgttcaaggggattcccttttacgaacagtcagtctacatgaaagtacagctgtggatatgcgctctgttcctggctgattttgtgttggaatggtttctggcagagaagaaggggcactatgtagccacacatttcattttcctactggtagccataccttaccaaaatatcattgcctatatgggatggactttctcaccggaaataacctatatgttgcgctttatcccattagtacggggtggatatgccatggctatcgtagtgggttggctgacgtacaaccgtgcatcgggactgttcgtttcctatcttaccatgctgctggccaccgtctatttttccagcctggccttttatgtcatggagcatggtcccaatcctctggtcaaaggatatggagatgctttgtggtgggcatttatggatgtgacgacggtaggttccaatatcatagcagtcactcccaccggacgggtactgtctgtactgctggctgcgctgggcatgatgatgttccctatctttacagtgtatgtaacgagcctggtcgaacggcgcaataaggaaaaagaagagttctacaagaaagcggcacagaagcccgcgcctaaagctgatgcttcctgaatagttaaaaccggaattttcacttatccgttgggaacaactcttcccaagtgttgttatagacgctgattttgaatatatttttcatctaaaaccttaacttatggcaaatattaaacaaacagtgaagctgggggtatttaccctggcaatcatgaatgtgacggcagtagtatccctacgtggacttcctgccgaggccgtgtacggaatgagttcggccttctactacttatttgcagccattgtttttctgattccgacgtcacttgtcgccgcggaactggctgccatgtttcaagacaagcaaggcggtgtgttccgctgggtaggcgaagcctacggaaaaaagctgggcttccttgccatctgggtacaatggattgaaagtacaatctggtatcctaccgtattgacattcggtgccgtatccattgctttcatcggcatgaacgacgtacacgacatgtcactggccaacaacaaatattactcgctcgtcgttgtcctcatcatctactggctagccacattcatctccatgaagggtatgagctgggtaggtaaagtggcaaaagtcggcggcctggtcgggaccattattcctgccgcactgctgattatcctaggtatcatctaccttgccaccggcggacactccaacctggatttccacagcagcttcttccccgacttgacgaacttcgacaacgtggtgcttgctgccagtatcttcctcttctatgccggtatggaaatgggcggtattcacgtaaaagacgtgaacaatccctccaagaattatccgaaggcagtgttcatcggtgcggccattacggttatcatcttcgtactcggtactttctcactgggtatcatcatcccggccaaagacatcagtctgacacagagtctgcttgtaggcttcgacaactacttccattacatccgtgcttcctggctgtcaccgattattgccatcgctttggcattcggcgtactggcaggtgtattgacatgggttgccggtccgtccaaaggtatctttgccgtaggaaaagcaggctacatgcctccgttcttccaaaagacaaacaagctaggcgtacagaagaatatcctttatgtacaaggtggtgcagtaaccgtgttgagccttctattcgtagtcatgccttccgtacagagtttctaccagattctgtcacagctgactgtagtcctctatcttatcatgtatatgctgatgttctccggagccatcgtgctgcgttataagatgaagaagctgaaccgtccgttccgtatcggcaagaatggcaacggattgatgtggctcatcggtggtcttggtttctgcggatcattgctggcattcgtactgagctttatcccgcccagccagatttcaacaggcagcaacacagtatggttctccgtactcatcatcggtgcgctgattgtagtcattgccccattcattatttatgcttccaagaaaccgtcctgggttgacccgaacagtagcttcgaaccgttccattgggaagaacaacccgctgtacagacaaccggtaaaagtgttacaaatatggctaccggtagcgccactaccagcaacaatggcacaagtaattctaccacaagtggaaatatggcaaaagacacaaccaatatccccaaaggataaaaggttataagttgaaactaaaaaaggaatattcccggtgatttcggggatattccttttttagtgttatatgataccagaagacgggaatagtcagagatccaattcctgcattctctcccacgcccttctgctctcctccaccaactcttgcatgaccgacgccacagactgcactccctttccatgcagcaaggcagatacctgccctatttccagttccccttcttccaagtcaccctcaaaaataccacgtttggcacggccgcgccctaaaaggatacgaagttcttcctctgaagctcccacagcctcagcagcctctacggcgctgcgaaagttattgcgcaccagacgcaccggagccaacttcttcaaaagcagacgggtatccccttcttccaaatgcaagcagtaatccttgaacacctcgcttgcagaactctctgccgtcaaggcaaagcgtgtaccaatctgcacaccttccgcacccagcacccgggcagccaacatggcctcacccgttgcaatgccaccggcggcaatcagcggaagtgtagtaactgcacgtacagcaggtatcagacacagagtggtagtctcctccctcccattatgcccaccggcttcgaagccttcggcaactattgcatcaacacccgcctcttcagccttcacggcaaaacgcgaggacgaaacaacatgcaccaccgtgatgccacgctcgtgcaaccaaccggtccatttcttcgggctgccggcagatgtaaatacaatcttcactccctcgtcggccacaatctgcattatctcttctatctggggatacatcaagggaatgttcacaccaaaagcatgatgcgtagcctcacggcatttcctaatatgctcccgcaacgtttcgggatgcatcgaacctgcgccgagcaagcccagccctcccgcattgcttacagcagcagcaagtctccagccgctacaccacaccataccaccttgaattatcggatatcttattccgaatagagaagtcactctgttcattattactttttttaaaggtttactaatgaaaacaagaaggggagaaagaaagttcaaaatttgacaaaaagtgataaattactgttgttccaaaacagttatcgaatctccatacgccttcaatacttccagcgtacgggcacggcgcttgcgacctttgaaattccaaaactcacgggtaaaaggcgccatcaggtctaaaccggaaattccaccgccactggtaccctgccaaccgcccacagccatattattggcccgctccgtcacccggtaacgcaaaccggttgcttcaatctgctccaccgtctcacgcggaccagcatcaaacggatgtttagcccagttcgtaggaatcatcagaatcttaagtgcataaaattcgtctccccgccaagtatctttgtccaccttaatctttttctggtaaatggggtcccaattatatttagtattggccgtataagggcgtagggtaagcacaacctttttctcgggcactttcggtatgacgggcagcgaattatcaaaatccatccatgacttgtccgtcaccgctttcggagtacctaaggaactgttcatttcaagttccttcaatacctccggattcagcttcacctccccttctcccttcagcaaccagttcagcctcaacgagtcttgagaagtccaattttgggcataaaaagggaaggctactgcacagagcaaccccattacaagtataaatctcttcacttgacagtttgattacttaatacctaatccttaatccctaatccctaaaaacatttcaccaccacatatatccactgccacaaagtggttcgtcatagcagggatcaatcgtccacatagtccgtggatacttacgggtttcccaccaacggcggtagcgcgaggcggcatccagcacctcttcgtccgaaaggaagtaaataccttcataattctccgcatccgtatgcaccatcttgcatcccatcgaagcattgttcccgagacggatagtctctaccgtccacaagatgcattcgcccaaacgcaacttaccacctgccgaataggataccggagccaaggggaaagagggaataaccgtcaagtcctcggcatacttcagcaattcctctatatcttcggaagtgaacttgggcatattactcaatccatccggactttgggtagaatatttaccagccttcaactgcttgacaaacaagtctacatccggatggttgtagtccaacgtttctttgctgcaagagcccaaagagagaacagaaagagtaaagaatatgagcagcatagtctgcccgaatatatgtaatttattgtatagagtcttcatatttgtatggtatttaagattaataagtcatgcgcacgccgcacaacagattcagattggtgggccgttccgtacgcaaggttcttgtctgcgagtccgtatcgaaatgatgggatacagacggctctgcaaacaaggcaaaacggtcgttcattttatagcgtacccctactccggcagcaaccgacaactgtaccggctctgcgccgaaatcattgtccggagcacctgcaatgcatttctcggctgctccgcctaccatagcatagaaatccactttcggcgtactggccagcatcatgttcagccttaccggaacttccagcgtatgcaacgtatggtcaccatccaagcaattatactgaagaccagcttccaaggagaaatgcttgttcaaacgacgttccacgcttaccccggccgtgaacggcatatgaaaattccctttcggcagggaaatgccgatgcctgctttcaatgcccaattacggggcttggatggcgatacagccacagactttgccggttcttcctcagaagatggcagcattctatctatatcagcatccttatggccaggatttgaatggtagttcccgtttccggccggagttccgttactgtaataaccgtttcccggctgctgccggtttccgtacacccgttgggtaatccggatggaaacatggacagacacggattcatcctcatcggcctgcgccgtcaatcctgccggaatgccgttggcgggatgctgtgtaccgggcttttgtgccatggggttggcctgatggatagagggaaaactttcctgcaccacatccccgttcaagttaccttccggcgtcatggccgccacttgtgtaaaggcctccttgatttcctctttcggagagaaataccagaaagcggcagaagcagctcccagtacaaatacaacagaggcggctgcggctacgcggtgaaacctcggagaaagaaaaagctgcctcctgccttttgcggcaaccggtgacggcaagtcacgttgcaacccttcccagaagtcctcccgcactgtcatctctgcgccggcaagacgactgcggaataaaccggttatttcatcattttctctcatattcagtatattctttaattctttttattaacaaacacttggcacgatgcaactgcgaggtagacgaatgctctttgatgtggaggatttcggctatttccttgtgcgatttctcctcaaagacgtataagttgaatacagtacggcatccatcgggaagttccgccacgaacgccatcagcatttcttcggaaatgcggcctccggtttcggcaatgcccgcttcatccggaatgtcgggcaattgttcctcattcaccaccagttggctgaaacgttgctgtttccgcaggtagtctatcgcctgcgtcaccattacccttgtcacccaggtacccaatgcacattcgccacggaaggtgaagtgggtgaaaattttgatgaagccatcgtgcaatacgtcatgggccgcatcgacatcgcccgtatagcggtaacataccgccagcatctgcttggagtagagggtgtataattcctttcgggcggaatcctttcctgcccggcagccctcaatcagttctatctcattttccaatgtcagtgctcgttttacggacgcctcttcgcgtcgtttgttagttagacgcagcattgcggaaaatgctgctgaattaattctaaaaagaagttaaagaacggagattatttatatttggctctcaaagcctgtatttgcttgtccagcatctcatccaattcatcaaattcatgccaatacagaaaaccgggaaccatgttgacgtaattgataaatttcttatactgcacaagaaacaaggcctggtcccgaagactgtcgtcaccatcaaaaacatgcgccaactccctggacatggcagcactcataagagcatctgttttcgttgcatagtaatcactgacatccttttgtttcctgcccaactcaaaataagtctgcaatacatcctgcaacatacgtttgtccggtatatactgcatcaatgaagaacctttcagcacgtccagcgcatctgtcctataagagaattcatccatattattgaaaagcttgccatacttccacagagtatctatcggtatcttggatacatccatatcatgttccctcaacaacagactcatgtgtatgtcaatatccaacaagtgctttatattacggagctcctgcctattatattccaactcttccgttaccaactgcatcgtagcacgcacttccttttgacgggcattctcggtaatccggtcacttccccagaaagtgacaatgatacccgcagccacaatactgaactgacggaaataatcacctatgtgccaactttttaccgtatggttcagcctattaaagtttatctttcccatatctttttattctaaatgatacttcttttcaagcgcttgtattgcctcgtctatacgttttcccacacgttctacatagtccggcgtgaaatagttctgcgctaccctgacaaagttccgtaccgacctgtccgacaagtaaatatcccacgcctcatatcctccacgatttatctggtccgtctgttcgtcagtcaatgccaaatggaaaggaaccataatttcgtccttcatatcgtaatagccattcatagttgccttaaatccatccaatacctcatagattccggtcaactgcaacagtagctctttatctgaaatcttctgcatcaacatggagtttttaagtatatccaatgcattctgactataataaaaactgcggatatgccccataagaaagcggaactgtatcaatgaatcttccggtatcgtccgatgctttaagtcatgctccaccaataagctggaaagacgttcatcctctctaaactctgaaacgatactcttataattttcccggttacttttcagttcatccctaatcagcgacatggtggcttgaatatcctttttctcggagttttgagtaaccaactcactaccgacaaaagtaatcagtacgccaatcaccacaatggaagtctgccggatgtagtctcccacttgccaatctttgacagttgtttttactttattccatgttatgtttttcatatcttcctacactattatccattactatgaaacacatcatccgttatagccaaacgcatcatctatccgtcccaaacagaccatctgtttcaccccaatacaccttctgtttttccaagagccactactttgctagttaccaatagaaagcctctcataaatctgccgtaatgcagcattctttatgagaggctttccttattattctgcaataatgctttccgcctttatcaacatgctttaaagctcatgtccaatcctttcacggagtgagtcaaagctcctacggaaataaagtctacaccgcattcggcatagtcgcggagcgtatcaaacgtgatgccaccggaagattccgtttcatagcggccacctaccatctccacagctttctttgtcattgccggggtgaagttgtcaaacatgatacggtctacgccacccaggtcgagtacttgctgcaattcgtcgaagttgcgcacttctatttctatcttgaggtccttacctttttccttgcaatattccttcgcacggttgatggccttgtcaatgcctcccgcaaagtccacatggttgtctttcagcaaaatcatgtcgaacaagccgatacggtggtttacaccgccaccgattttcaccgccattttctcgaggatacgcatgcccggagtagtcttgcgggtatcgagtacacgggtattcgtacctttcaattgctcggcatacttatgtgtcatggtggcaatgccactcatgcgctgcatgatgttcagcatcagacgctccgtttgcaacaaagactgtatcttgccttccacaatcatggccacatcacccggctttacggctgtaccgtcattaataaacacttccaccttcatggtagggtcgaaacgacggaacacctccttggctatctcgataccggccagtatgcccggttcttttatcagcagtttggacttgcccattgccgtagcaggaatgcatgaaagggttgtatggtctccatcgcctatatcttcggcgaaagccaggtctatcagcctgtcaatcaattcttcttccttattcatctgttttatctatccttatttgatgtataacatatttgttctgtacttttctgaagaaacaattcacccgaaagtttccatttgcggtcgtcaaggtaccaatgacgaaaccagactcatcacgtttcccctgatggttcacattaaaactgccaaccttgtggttggagaagaaagcagccattgtgccctctgccgtccgcttgtcggcgtgggtcgacttattctgaatgattaaatcgaccttgtcacccagatacttgttgagttcctgagagcttccttccttgaaggccccaatcactccctcgggaacgttctgggccagcagcacagacgtccaaatgaagagaccggtcaacaaaaagactacccgttttttcattttcacaagtatttatgataggcaaaggtaagcatttgtctcaaaatacaataaaaaaatgctaaatttgtgcgctaatcaaaacagaaccagtatgaaaactactctgctcgtcgtaggacggactgtagaacaacactttataacagccatcaacgactatgtgcaacgcaccaagcgctatctctcattcgagatggaagtcatccccgaactgaaaaacaccaaaagcctctctatggaagttcagaaggaaaaagaaggggaactgatactgaaagctctccagccgggagatgtggtcgtactgctggacgaaggtggaaaagagatgcgctccatagagtttgcagactatatgaagcgcaagatgaataccgtaaacaaacggctggtatttattatcggaggcccttacggattctctcaaaaagtatacgaagcggcacacgagaagatgtccctctcacgcatgaccttttcccatcagatggtacgcctcatttttgtggaacaactctacagggcaatgaacatactaaatggggggccgtatcatcatgaataattaaaatgctcgggcagccagcgtacaatagagcgcaacactatgcggtgttctacgcaaggtttgatgtacacttgtaaaggtgctgcccgttcagctcaatagcaatactcaccacattctcacaggtaaacaaggagtaaggcagagtgttcgtccatcctcccaccatatccatacgtacggagctatgccccccatactatctggaatggcttttccaatcaagttcgttatttaaaacagagaaaagaattgattaagagttaagaattgtcgaaaaaatattattaaggattcttagtaaatttctcagtaataaaagatggaaatacacatgaacagatacaaacaattaatagcgtgcaatacacgatactaacaacatgtcgtgcaagaagttaacaacgtgtcatacaaaaaataaatatcgtgtttgcaggatattaacctcctgcaaacacgatatttatttgcttttatacaaagctatacgaggctgaccacctgctgcaacagccccggcaattcaaaagtagcattcttgatatccgaaatccggttcttgccttctgtcgtaagaaaaaaacgcatctgacgcttatcttccttacctatcagacgggtaatgagtttcttttcctctacggaacgaatgacctttgaagtgttggaggcagacaaacccagtgcctcagctatcttactggaggtaagcttaggagtattgagcagcgtgcacaacagcattccttcattcagtgacaaatcgtacatctgcgtaaactgcacctcgaattcggcaatagcccgataaatatcacgaattttacataaagtctccatatctttttctcctatataaataagttcacatttgctttgtccgcacgttccatataggtagccacgccaccgatggttacttcatccagaagttcttcgtgccggatgcccatcatatccatagacatctggcaagcgatgaattccactccttgcgccaatgcttgcgagcgcaacgactccagagaatccacacccttgcgcttcatcaggaagcgcatcatgcgactgcccatgccaaacatattcatctgcgacaacttcagtttcaaagaactggccggcagcatcatgccgaacatcttgccgaagaaatctttctgcacgctgggtttctgcactttcttcaagacgttcagtccccagaaggtgaagaaaatggttactttctgtcccgttgccgctgctccgtttgccaaaacgaaggttgccagcgctttgtccaggtcgtcactgaacagaatcagcgtctttcccctccccccggctacgggagtgttggaagcggatgtacaagccggagcgcctttttcgatgactaccgtatagcgtcctttctcgtcatgcttctctatcaatttatttcccgttgtatcgcaccaggcagaggcgtcgcgggcaaaaccggcatcggtagccacaatctccacacgctcgcccacagcaatgctatccatcgccttcttcacctgcatgataggtcccggacattgcaagccgcaagcgtttatcttcaacggttcctttttggagacagatgccgccgcaggaacatcgtcgttgtcagcagaggcagccgaagaagcagaagaagagtcacctcctgccggagcagatggagacggcagaggcgctgttgccatggaataggtcttataaccacctatcagattgcgcacattgcgataaccgcgtcccatcaggatgcgcagggacagataaccacgcaaacccacagcacagaaaagcactaccggcttgtccgtaggtatctctgccaaatgctcgcgcatttcatccaacggaatattaacagctcccggaatggtgccgaaagagaactcctcgggcgtacgggtatctatcagcatcactttatccttctcttccaccaactcgcgccaagagatgacgggcatagcaccgctaataatattcgatgccacatatccgccaatggcgatggggtctttggctgaggagaaaggaggtgcatacgtatgctccgtctccatcaaatcgtagactgtgccaccctgcttgatgagtccggcaatctggtcgattcgcttgtccaccccctcgtaaccgatacattgcgcgccatagagtttaccggttttaggatggaaagtcagtttcaaagtcaaaggcagggcatccggatagtaaccggcgtgagatgccgagtgcgtcaccgagctttggtattccatgccccactgcttcaagcgtttggctgcaagacccgtagaagctaccgtcatgtcgaatactttggcaatggaggtgccgatagctccttcgtaggagacggtattgccaaacaccatattatcggcaacgatacgtccctggcggttggcagggtttgccaggtaattgagccacggctttccggtcagcggatgaggatattcgatggcatcgcccacggcatagatgtctttttcggaagtctccaagtgttcgtctacccagataccgcccatctcgcccaacttcaagccggcttgttgcgccaatacagtggcaggacgcacaccgatggagagcaacaccatatcggcaggaatggtctttccgcttttcaggaatacagtgattccgttgtccgtacgcttgaaatgggtcacgccttcttccagatagagggagacgcctttctgtaacaaatgctgatggatgggtgccgccatggagaaatcgataggcgccattacctgattacccatttcgactacggacacatggacacctgcatgatgcaggttctctgccatctccaatccgatgaaaccggcacctaccaccacggcgcgcttcacctgcttgtctgagatataagccttgatatggtcggtatcttctacattgcgcaacgtgaagatgccttcggaattgatgccttccaaggggggcttcacggggttggcaccgggagaaagcaaaagtttgtcatagctttcgtcgtactccttaccttccgcgttgcgtatggtaacagtcttgtttttgggatggatggcgattacttcattctgcacacgcacatcaatacggaagcgcttgccgaaagattcgggtgtctgtaccagcagcttctcacgctctgctatcactccgcctatataataaggtaaaccacaattagcatacgagatgtaagggcctttctccaataagaggatttcagccatttcgtccactcttctcagtcgggcggctgctgtggctccacccgctacaccgccaatgattacatatttcataattcttcgtcttttaagtttgatgatacaaagaaaagaattactttcaataaaacataatttccaaaggaaaatattattaaaagacttatatttaatgagaacggacataaaaaaaggattattacaagttgttacacctataataatccattcagtatgcagttttttataagcttaccaaccaagccgagcaagaccgacagcactataccatgaagtagaacgataagcggcattagcagcttgggcaacagcagaagtagcagtggaaggtatataatggctaaccccatttgcccgcttcatggagaacataccaacagacatcgaataaatcatcggtgtttttttccaacagacagaagctgcatcatatgcttgcttccattcatccaaggcaacttcatccacaacgagtttttccaccatttctacgaaatcataatagcctacataataagacgatcctactttacgctgatcataattaaagaccaatgaccgaagaacttctctatctgctgtcactcccgacaaaacatttgctgtagcagcagctaagttctcaagctcagaagatttcagcacatctatagcagtgcccatcgtccaattgctattactccctatttttccagtataaatttcatcataagcagcaaaagtcccaatagccatttctaccgctgcacctttctgaaatataaatggaaacattctatcataggcagcaccaggacctggattctcagcagggaaaccaatatagtaatcgcaataatcacgcaactcatacgcgacttccaccgactgcataaagcaagcatcaaacataataaaatcaaaatgaggagccttctgtaatactgacttcaagtcctcaatattcatataatgtcctcctccagtcttatcatttcctatccagcgagtagaaggcaatggagtaggtatccatccttccccatgcgaccaataaatcaaaccataactttccgctttatataaagaattcccaaacacatcattgaatacctcctgcgtctcagcgactccacacgaatttctatcttcatattctttgactattgtttcaacaacagtaccacctttattttcaatttcaatcaaacgaggagatcccgtatctatatacaccaataaatgcatatcagatgtattatcaattgaagccatcccagctttcaattcctccaaatccccatccgtaaagctagccaatggatttatactattatccgctgccatatataccagcacagtacgtttcccatcaaccggaggatcaggtatcgggtcgtcaccacggcacgccgacatgaacaaggggaaaacaaagaaaaaaagaagatatagttgtgttttcatacttgaaatcttattcctgcggttttgtaaacgtgaaagcctcaggcttcaccacctgcaaaaccatattcttactctttttatacttgccttttacctttacagcctctttttccaactttttcttgttttcagagaaataaatcatgcaagtataatcaggtttcttcagattgtactccagatagttcttaagctggtaagtgtataaatcacgcttgggcaagaatccattcttatccagctctacgctgtccaatacctggatgtctgtataatatacgatggaatcattgaaagaagccgccaccccaaaagcatatacagccttttccttatctttcattgtaaaagccgaacacaacgcaaaaaccaaagctacggcacaaagtatacgaacgtatttcattgagttatgagttataagttatgaattatcaatggggcaaagatataaaaaaaaccgcacgcctactaaagacgtacggtttttaattccttctatttgtcggaaactgatatttcttatttatcccaaataagatttgagcaatttactacgattactttgtcttaatcttctgattgctttttccttaatctgacgcacacgctcacgggtcaagccgaatttgtcgccgatttcctctaatgtcatttcctgctgtccgataccgaaaaacatctgtatgatttctttttccctatcggttaacgtagaaagagctctatcaatttccctcgcaagagactcgttcaccaaagagcggtcagccataggggagtcatcgttgaccaacacatcgagcaagctgttgtcctctccttctacaaaaggtgcgtccaccgaaatgtgacggccggacaccttcagcgtatcagagattttgtcaacagggatttccagttcatcggcaagctcttcaggagacggacgacgttcgttttcctgctcgaacttggagaaggccttgctgattttattcagcgaacctacctggttcaacggaagacgtacaatacgcgactgctctgccaaagcctgcagaatggactgacgtatccaccatactgcataactgatgaacttgaaaccacgtgtttcatcgaacttttcggcagccttgatcagtcctaaattaccctcattaatcaagtcgggcaaactcaaaccttggttttggtactgcttggccacagatacaacgaaacgcagattggcacgtgtcaatttctccagtgcaacacggtcacccttgcggatgcgctgagcgagctccacttcctcttcaacagtaatgaggtcttcgcgaccgatttcctgcaaatacttgtcaagagaagcgctctctctgttagtgatactttttgtaattttaagttgtctcattcttataatacagatttgggttgcaaaggtacgacaaattattttgttacaataatttcatcccaactttttcaccttatttatatcttatcctatataacaaaaaggatgccggtatgtattgtaccgacaccccctttttcgctattgttagctaatattacaatcttcttacctaactatccctattttttattcttgagtcaaatcaacggcatacattgcacgttttcctgacgggaacataccggtgatgaacaaaccttgctcaggagactttcttgcctctttcatcgccttttccaaatcgtccaccgtcttcatcggcactccgttggctttcagaatgatgaagcccttgcggatacctgcatcggccatcttgccattggtaaccccggtaacttccagaccgtaacccaggttcaactgcttcttcagctcggaagatacgggcttgaaggctgcacccaagatttccattccggcatccttcactaccttcgtagtgccttgctcattcttcagcgtgatttcgaattccttttccttcttgtcacgaaccaccgttaccttcactttgtcgcccggacggtgttttgccagcatttcctgcaaatccgagaacttgtgaatcttcttgccgttcaatgctatgattacatcattttccttcaagatgccggcagcggaaccaccttcaacaacttcggccacatagataccctctttcacaccaagttcgtcggccttcttcttcagttcttcggtccagcgttcgtccatctgcaggtctgtgctcaaatcactacccttgatgccaaggagcgcgcgctgcacggtaccaaactgtttcaagtcggctaccacctttgtcataatgctggtagggatggcaaaaccataaccggaataagcacccgtgggtgagtaaagcatggcattgataccaaccaactcgcctttggcattcaccaatgcaccgccactgttaccttggttgatggcagcatccgtctgaatgaaagactggatgtttgcagcttgtccgttggaggcagaagaaccaatggaacgggcttttgcactgacgataccggctgttacggtagagttcaggttgaacggattacctactgccaacacccattcccccaccttcaactgatcggagtcaccaaccggaattgtcgggaagtcatccccttcaatcttaatcagcgccaagtccgtactggggtcagtaccgatgatgcgtcctttcagctcacggtcgtcattcagtttcacggtgatttcatcagcaccttccaccacgtgattgttcgtcacaatatatccgtctttggagatgatgacacccgaaccgaaacctacacgcggctgggtctgtatctggcgctggcgtccacgaccgtctccaaagaagaagtcaaaaatatccggttgttcttgcaccgtctgagtcttactcaactgagtggcacgtatatgcactacagcatggagcgaactctccgctgcttgtgtcaaatccacaggctgggcatccgttgcatggaaagctgccggcagcagattattcgggttctgttggaacaactcgctgaatgcggcaggcttttccttattcagcatcttataagtggtcaatccagccactccagagctcaagagcacgatagccgcaactccaaggatgttttttgttgtctgtttcatactattcttcctattctttaaattgttaatattcaagtttcgtttaacattacgacgttaaaataacgacaaaaaacgttcagttattccgcttgtcactcttttttgttctcttttaacaaaggatatttagggcttaacagcggttaacggcaaagactgacaaattagcatttatgtacgattgctgactgttaaagaactgacagatagagcataaaaagacgcatcacccgttgcggccgaaacggatgatgcatctgtttttagagggcagatagtaccttaataattcaagtaatcaatgtccatgtggtagtcccactgtgggaagtagaggttacctcccttccactccacctcgccacgttgaaagtcgacagtctcgctgcggggatactgcttttcgggctgtagcggcatgccgtaatcagtgttcacaatcatgcgccaggagtcgataccacccaggaagaaatattcttcgtcggcattgcaggcaaaggcaggaatgccgaatgactggtcgacaggcacccaacccacaccctcaaaatagacttctgcccaatcgtgcagattccatgcacggggatgcatcatgaagccgctctggaaatgtgcgggaattccactgatgcggcaaagcgtaatgaacagcaggctgacttggccacagtctccgtgacggttgtccaacacatattccgggatattctcaatggtggaatattcgcgtgcagaagcccacgggaagttgtcattcacccaacggaagatacgtttggctttcaagtaggggttggtttcaccggctgtcaatttggcagcaagttcgcgcaagcgcggggaaaagacgatatgcttctcacgctcggcagtatattccttataaagagcggtcgtcgtatcatagggctgcacgtcttccggcttcagattatgccattcgccgttggcggtaaactcaaaggtttcggagaatacggtaggttcgccttcgacagcacgtttctccatgtacaatgtactgtgacggcactcgggcgacgaaaaggtgtattgcggttcactggccgaaatgaacttgacatcctgctgccgggcctggtcctgacggggatagggcaaccagcaacggatgattttcccggcaggtacggcattggtatccacgatcaacgtgtaggtgacgcgcatgcgcttcggctcaacaatggccttgccctccttcttcacagcagaaatgatttcgggcaggttctccatattcactttctcgctgccactcggcgaagtaccttccttggctatcttgatgtcatagcaagtggagtccacacgaaacagattaggtccggcattgcggaaatagcgtttctctccatccagcatcatgcactccaaagctttggaggcttcccactggcgcatctgctcatcggtcacgtcgggaatatacttgcggatatagtccttcacctgggattccgtcatacagaagtccgtaagcagacgttggtgcaggtcgtcctcccaattgtagggcttgctctcgggcttcgtgctgcatgcagaagccatcacaaacagagcgacggtatacaatagctttctcataacttcaccactccaatacccggcaattcgggcaacgttatcttacctttcacaacctccatacccttgaaacggtcattcgcaatcaacagactaccgtccaagtcagcaaagtccactgccggagagaattgggaggcagcggtaatggcacaagaggtctcggtcatacagcctaccatcactttcatgtccaatgcacgtgccaaagtcaccatcttccaggcttcgcgcatgccggtacacttcatcagcttgatgttgatgcccgtaaaggcgcccttcaagcctgccacatccttcagacgctggatggactcatcggcaaatatgggtaacgggctttgctgagcgacccatgcgatatcgtccaattgttccttgggcatcggttgctctatcatgacaattcctttttcgtgcagccaatgtatcatatcgagcgcatgatgtttgtctttccagccctggttggcatcaatggcaatcggaaggtccgtcaccgaacggatggtctctatcatttctttgtcgttctcccgccccagcttcactttaaggatattgaaccggtcggcacactctttcgtcttttcacgcaccacgtcggccgtatcaataccgatggtgaaagttgtaaagggagtcttctccttgtccaacccccatatcttataccaaggggcttgcaacagtttgcccacaaggtcgtgcaaggcgatgtccacagcagttttagcagcggaatcccctgccgagaggctgtctatataagccagtatatcttccagctgaaaggggtctgagaattggccgatgacatcctgcaccttcttcaaaaaagctaatacactgtccatcgtacctagttcgtgttgcaggtacgggggcatggaggcttcaccataaccgataatgccatcatattctatctcgacctgaacgtcgggagtggtagtacgcgagtaggtggccactgtaaagacatggcgcaatttcagttcataggggaagaaacgcagtttcatttttggggttacacctgccctactgttcacgttgaacaaggaaggagcgtcatttcctccggcaaatacatgattgattgccatgcctgagccgagtgcggcaaaagcggcggttttcaggaaatctcttctgtttgacataattgtgtgtgtattaaatgtgccaatatgctaatgtactaatatgccaatgggctgcactatatatactacgtcatgtttgcaccgtcacgccgaggtcattggcatattggcacattagcacattattacattgaataaaatggattcgtttccgttgtattgagcgacgcctccttatttatataaggtaacacgcgcgtagcgaacaacagtctaccgagattgtattcatcgaacagctcgtcgtcggggctgaagctattgacgcgcacatcgccttgcgaatggatgaaacgcttgttgccgatatacatgccgacatgtaccacacgttccttgcgttccggcgtcgccttacgcccgaagaaaatcaaatcgcccggctggaggttactgaaatcaggaacgatatcgatatgcttgcccacgtatgcctgctgggaagcatcccgcggaatgatgatgtcgtgcatgaaaagaacggtgcgcatgaagccgctacaatccacccctttggaggaagtgccagcccaaagataagggatgcccatcatgctatgcgccgtagctataatgctggctgcgtcctgcttcaaggctgcccgccattttttttcaggcatagagatggatttggagatatatccctggcggccgtcgggataagccaccttataaaaggcaccttttgtcccctcccacttcaggcggtttccggcagcaacatcagagacggtctgcgatacctggctgggctgtgagtagacaaagccgtaatgcgaagtcaccactattttctccgcattgttccaagcggtcagctcttcccgcgtgacgggatgtatgcctacccggtgtacccatgcaatgtagttgtccggtgtctggatacggtaccagccgtcgcgctgcaacacccgcaccggcatccccatcaagccttgcgtcatcatttctgaagagaaatccgggtctacccgaagattgcacacagacacattgacaatgccatacgtcttgccttcaagtccggtctcatccggaagcacttgcagacaatccatcaccgcatatcctttctttgccaaaccatccagcaaagccgtctttgcttctgccgaagtggtgacaccacgcaacatcacattctttccggagaaagagtaatctacatcgaacaaagctacgcgcttgtccggtgcaaacttttgtttcaaactgtcagcgagttgcgccacctctgcagggatggtacggtcacccacttccgaagcgacagcaaaaagcgggattaacagaaataaaggaaaaagagaggataactttttcattggtcaaaaggatttgggggttattactaatagcaaagctacgaatttattccgaaatagatacatgtttttaagataattaagggtaaagaatgaagaatgaaggattcatccgtactgcatccgcacactgcacaacaaattcttcatccttcattcttcattcttcattaatattccgtatctttgtacccctataaaagcagttggtcggtctgtcgcttgcgccttcgtgcgtatgaggaaagtccgggcaacacagagcgtcccacttcctaacagaaagctgtccgtgagggtagagtaacgtagaagaaaataaccgccgtcgccctcgggctatggtaagggtgagaaggtggggtaagagcctaccagtcttgtggcgacacaagggctgtgcgtcttgggagttgtaaggtcatgtaaaccgacgttatgagagttgctcgctccatgtcggagggtagaccgctaaagcttgtatggtgacatgcggctcagataaatgacagacacttcttttaatgaagaatggataattcctaattagactttttcaggaacagaagaacagaacccggcttacagaccgactgcttttttatttcttttctcctatctgtgataatcccctttatctttaatcagtatgaccttcagttgggggtctttcaacatctgccgtcccttatgtgaagccaacaatgcaagttgggtagtccggtgtctccaagtcagcaagtcaatgggacggttcagttcctcttttatgacagaataccaccagcccggaaaagacaatgcacgaacagcacctccatcaacaatcttctgcaattcagcaatgcaagcatccagttccctatcgctcaaatcattaggtttatcaaaagctacataataagatgtataatatccgttttctgtaaaaagcctcaatgcttcccaattggaactttcaataatcaactcatctttctccatacgataagtttcaaccaacttattcaattcagcgagtatttccgtcttgttgcctgccttcaagttcttaatatccaaccaaattttaccatcagtctcattcatataagagaaataaggctccagaaccagattaaaacttgtatccacatcatgcgtcacatcaaacttccggtttttccgaaaaacgacatcaacttccacgttaggatactcgtcaccttgctcataaagtttttctatcgaattacatcgatgcagccatatcttttcgggataatcattcataagtagggctcctataactaaattactccccacccatgctaacaatacagccaacaaaactaccagaattctctttttgcgcatattttcagtctttttatctctaataaactttctttcccgcaaaatacataaaaagaatattcttaaacaaaacctccactccatttctacctttttattcgtttattccagaaattttatataattttgcacttcatataaacagagatcattgagaatccgttaaagataactctttgaacttacgctaattgacattttatgaatagacgtattgcagccttctggaagtttcttacttacgacatctggcgtattacagaagatgaagttacgcgaaccactttttccgtatacaatatcatcaagaccatctacctttgtgtcaaccgcttcaccaaagaccggatagtaaacaaagcctcggcactgacttacagcaccttgcttgccattgtaccgattctcgctatattgtttgccatcgcacgcggtttcggattcgacaatctgatggaaagtcaggttatcaacgggttcggaggtcctacagaaaccacagaggttattctacagttcgtaaactcatatctctcacaaaccaaaagtggaatattcatcggcatcgggttgattatgttgctgtggacagtcctgaacctaatcaataatatggaagtcaccttcaaccgcatctggcaggtaaaaaaggcgcgcagcatgtaccgcaaaataacggattacttctccatgcttctgttgatgcccattctgctggtagtgtccggtggtctttccatcttcatgagtacgatggtgaagaacctcgaagactttaccctactggcacccgtcggcaagtttatggtacgcctcatccccttcgtactgacctggttcatgtttacagtactgtacgtctttatgccgaatacaaaagtcaaactaaaacacgcactcatatccggtattctggcaggtacggcacatcaggcattccagttcctctacatcagcagccagttgtgggtttcccgttacaatgccatctatggtagtttcgccgccctcccgatgtttctgctatggttgcaggtatcttggactatctgcctgttcggtgccgaattgacctacgccggacagaatatccggaacttcagcttcgacaaggatgcgcgcaacatcagccgtcgctaccgcgactttatctccatcctgataatgtccctcatagccaagcgctttgaacaagacgcccaaccctatacagccgaggagatatccgaagagtgccagattcccatccggctgacacacgaaaccctttatgaattgcaagaaatcaacctcctgcatgaagtggtgaccgatgaaaaaagtgaagacatcgcttaccagccttccatggacatcaacaagatgaatgtggccctcctgctggacaagctggacacacacggctcagaagacttcaaaattgataaagaaaatgaatttaacagccaatggggagcattgctgaaggcacgggaggaatactacaagaatgcaagcaaggtgctgctaaaggatttgtagtttggtttaaacacggaggcacagagattttttctcgtctattggtttaatccctgcacctctgtgttcttctgctaatgctaatacttattataagatactgtcttctcttttggcttccgcgatttcttccgtttttccttcaccggatagccaatcgtaatatctagcaaaaggcgtttaccggccgggataccgacaagtttctttatctccttctcatcaaaccagcccaaaatgcaggaacccagcccttcattttctgccgccaacgtgatatgtgcggcagcgataccaatatcaatcaatggaaaatacttacccttgatttttgcacccagaaaggaagtgacattcatggactcctccaccaccagaatatgaacgggagcatccttggcaaacttgttcatccccaatcctgcagcagccttgcccaccttgacagacagctccggttccgtaactaccacgaacttccacggttgtgcattgcaggcggacggagccagacaagccgctgccaatatccgctccagcttctcaggctccacggcacgagtcatatcataggcacggtcactctgacgggatgccactaattccaggaaatcgttcatagcgccgttaccttatttatattgtatcatgcgactgatgtacttaccaatgatatcgaactccaaattcaccacactgctcactttgaaagcatggaaattggtatgctcgaaggtgtaaggaatgatggctacctggaaagtatcgtcggtgggattacacacggtcaggctgacaccgttaaccgttaccgagcctttgtctaccgtaatgtagccgcgctttgccatctccttgtcaaaagcataccggaaagtaaagtaatagcttccttccgcatcctttatatcgatgcaagtggcagtctggtccacatgtccttgaacgatatggccatccagccggccgttcatcatcatactacgctccacattcacttcatctcccacctgcaacaagccaagattggaacggtccagcgtttccttcatggccgtcacggtataggtatcatctgtcaagctgactaccgtcaagcaaacaccgttgtgagacacactctggtctatttttaattcactgacgaatgaacacttgaaagtaaaatgtacattctcctggtctttgaccatcgccaccaatgtggcacattcttctactattccggaaaacatggttctatatacttttagattatacatgatttattattaatatgcgcaaagatacaaaaagcccttcgtataggtacaaaaaaaggaagcttttcacaaagcctcctttttcagttttcaataggtattagttttttttaaggtaaaaagattgttttcaggataacgatgcaaatataggcgcttttcgtgatactaaccaaattaaaaaacatgtcttataacatctttttgaaaaaaacatttaagtttattatcatttcaaagcacttttctacacctgcaatcgttttcaatggacaaatataaggctattttccatgaaatactgaaattatcctaaaattttgtttatttcttatcatttaagtagtgttcatctgtccgcccgctatgttttaacacttttgcgtcgataaagaacactatttcttcggcaatattcgtgatatggtcaccggaacgctccaacttgcggaacacgctcaccaggttcagacaagaaagtgcactctccggatgccggctgatgtagtcggcaaggatggcagtggcatcagcattgatttcgtccagcatattgtccttggcaaacacagcggtagccaattcctggctctcctcctgaagtgcctgcttggcaagctcgagcatggagagcacctgggctatcatctcttcaagacggagttgcttgaccaactcagtatccaatgccggttcatggcagttgagggcaaagcgggcgatgccttctgcaaagtcgcccagacgctccaggttcgtattgattttgagcatggcaagcacaaagcgcaggtcgatggcaacggggttgtaaagggcaatgatgtcctccacgtcgctgtctattttcagttcgaaagcattgacgcgacgttcgcgcaccaatacctgctgagctagctcccggtccagcgtaagcacggcatcacctgcacggtcgagctgattatataccagggtccacatttcgtctatttcctttttcagcaagacgagttcagattcgataaacttcaccataatgtttctattttaagattacttttgtacaacttatttttgcttgtatggaacaatccgctacccgaagcgtcccgtgatgtagttctgcgtttccaccttgtcgggattcgtaaatatcttccgggtatctccaaactccaccatccgccccatatagaagaaagccgtattatcactgacacgcgctgcctgctgcatgttgtgggtaacgatgacgatggtgtactgcttcttcaactcgtggataagctcttccaccttggcagtggagatggggtcgagggcggatgccggctcgtccatcagcaggaccgaaggagacaccgccatggcacgggctatgcagagacgttgctgctgaccgccggagagggcgtaggcggagactttcagcttgtccttcacctcgtcccaaagggcggcgcctttcagggtttcttccacccgctgacggatgaaagcgttatcggtgatgccatttacacggagtccgtaggcaacgttctcgaagatgctttttgggaaaggattggggcgctggaacaccatgcccacgttcttgcggagttcatccacttgcactccttttccatagatgtcttgtccgtcaatgcgtatctcgccggtcagacgggtgtcgggaatcaaatcattcatgcggtttagcaggcgcaggaaggtagactttccacagcccgagggaccgatgaaggctatcacagacttctcctcaatgtccatgctgatgcctttcagggcatggaaatcgccataccagaagttcacgtcacgggtttctatcttgttcttcatacctattgtatatgttttcaattcgtcttaatcttcttctcaaagtatttccgcagggcgttcgccagcaggttcaccaggaggataatgagtatcagcaccagtgccgtgccgtaggcaataggaagctgcgcttccatatcggtgccgctggtagagatgacgtagaggtgataaggaagcgccatgcactggtcgaagatacttgcaggcagctgtggcaagaagtaggcggcacaagtgaaaaggatgggtgccgtctcgcccgaaacacgccccaacgccagaatcagtccggtgatgatattgggcatccccatcggcaggatgacatgccagatggtctgaagcctggtagctcccaacgcgcggcttccctcacgcatgctgtcgggaatggctttcagcgcttcttccgtggtgcggataaccaaaggcagactcagcaggcccagtgtcaacgaacctgccaggatgctgtctccaaaatccatatagttgacgaacagcgccatgccaaacagaccgaacacgatggaagggatgccgctcaaattgttcgtcatcatccgtatgaagcgtaccacccagcccttcggcacatactcattcatataaataccgctcatcacccccaccggaaaagcaaacaaggcactgcccaccatcaagcagaacgtacctacaatggcaggaaggattccgccggcagtcataccgttggcaggagccgtagtgaggaactcccaatcgatgactcctatacctttatatataatgaaaccgaggatagcaaaaagaattcccaccacactcagactcaacagacggaacaagccgaatgccacgttttgcgaaagatgctttctattgaccatatctaccttcttttattttcgtcttggcgaaactgcttccaccgtgaaatttatcaataaactgatgaaaaacagcacgacacccagtaggaacaatgcttcgtagtgaggtccgccggcaggtgcctcgcccagctccgcggcaatcgtagccggaatagtacgcaacggctccagaatggtatggggaatgacggcagcattgcccgtcaccatcagcacagccatcgtctcgcccaccgcacggccgatgcccaacaccactccggaggtgatgcccgaaatggagtaaggaatcaccaccttatatatagtctgccattgcgacgctcccagtgccagactggcttcgcgcatggcacgagggcagtttctcatcgcatcttccgtcaccgtaatgatggtgggcagtgccataatggcaagcacaatactgcccgccagcccactctcgccgaccggcaagtcgaagacctgctgcaaaaaaggcacaatgacaatcaaaccgaaaaagccgtaaaccaccgacggtatgccactcagcaactcaatgataggtttcagcagattccttacccgggaattggctacctccgacatatagattgccaccgacagaccaaacggcagtgcaaaaaggatggcaaacagactgacccacaacgtccccgtaatgagcggcaaaaagccgaactgtgcagcaggtgttgccgtgggaaaccattcggcaccggcaaagacgtccttcaccgaaatggtgttgtctttcagcaaatgcactgagtccggacgaacgatgaactgctgcggtacaaaggctataataccgggcgtacgctccaccagctccgtaatgcaagcacctgcattttcataggaagcgcccaactgctcttccgtataatactgtgtgatgtcctccaaacggaaaaggcggataggaaggtcctcccctcccacttcgttccagtttgtcagctcttcatcaaagacatcctttatctgtgccggagtcagttcgcccacccgattctccttattcaaagccaatacatacccttcttctattaccttgctgctgaacaagcctagcgcttcggaaaagaggaacacgacgataagtacgatggtaaggctcgtcacaaagccgctacaagccagtataccttctacaatcttctcaaaaatctttttcatgttgcctattgatttctgtatgcaaaggaacggaccggatgttaaggtagtgtgactaacgtttgaaagaaatgtttcaaacgtgttacaaaaccattacaacgacttaaagtacaccccatgtaacacacttgtaatatccattgccttaatttgcatcatgcgttgagccagattacatgatgcataccatcggtttacatcatgtgtttgccccaattgcattatctgtttacccaatttgcaccatgtgttttatgaagacaagaaaattactcctactcctcgccctggcagctgccaccaccggcatgcaggcgcaacgcatcaaaggcagcgacaccgtgctccccatagcgcagcagaccgccgaacgctttatgaccctaaacccgtctgcccgtgtcactgtgaccggtggtggaacaggtgtcggtatttcagccctgctggaccaaaccacggacatcgccatggcttcacgcgccatcaagttcagcgaaaagatgaaagtcaaagctgccggagaagacttggcagaagtacccatcgcctacgacgcccttgccgtagtggttcacccctccaacccggtgaaacaactgacccggcagcaactggaagacatcttccggggcaaaatcaccaactggcagcaagtgggcggagacgaccgcaaaatcgtagtctactcccgcgagacttcctccggtacctacgagttcttcaaggaaagtgtactgaaaaacaagaactacatgagcagcagtctctccatgcctgccacgggagccattatccaatccgtcagccagacacgcggtgccatcggatatgtgggcctagcctatgtatcgccgcgtatcaagacactcgccgtttcatacgacgggcagcattatgccgctcccacactggagaatgccaccaataagacttatccgatagtgcgcccgctatactattattataaccggaaaaacgcctcggtcgtagcccctctgctcgatttcatcttgtctgccgcaggacagaaaatcatcaaagagagcggatatatcccggtacataaagaataaatcttcattcttcattcttcattcttcatttttttaccctatctttgcccccacgatacgaaaatagtaacattatggcagaaataaagagcgaagaaacaagcgaaaaaaagagcttgaacttcattgagcaaatagtagaaaacgatttgaaagagggtaaaaacgggggaaaagtacagacacgcttcccgcccgaaccgaacggttacctccacatcggacacgccaaggccatctgccttgatttcggtattgccgccgcacacggcggtgtctgcaacctgcgtttcgatgacaccaatcccaccaaagaagatgtagaatacgtagaggccattaaggaagacatccaatggctgggctacaaatggggtaacgaatattacgcttccgactatttccagcaattgtgggacttcgctatccgcctcatcaaagagggcaaggcatacatcgacgaacagacttccgagcagattgccgcccagaaaggcacccccacccagcccggtgtggaaagcccttaccgcaaccgccccattgaagagacactggatttattccagaagatgaacagcggcgagattgaggaaggtgccatggtgctccgtgccaagatagacatggcaagccccaacatgcacttccgcgaccccatcatctaccgtgtagtgaagcatccgcaccatcgcacgggtaccacttggaaggcttatccgatgtacgacttcgcccacggacaaagcgacttcttcgaaggcgtgacacactcgctctgcacactggagtttgtgccccaccgtccgctctacgacctcttcgtggactgggtgaaggaaggcaaagacctcgacgataaccgcccccatcagtatgagttcaacaaactgaacctcagctatacgctgatgagcaagcgcaacctgctgatgctggtcaaggaaggcttggtaaacggttgggacgacccccgtatgccgaccatctgcggttttcgccgtcgcggttactctccggagtccatccataagttcatcgacaagattggctataccacatacgacgcccttaatgaattcgccctgctggaaagcgccgtgcgcgaggacctgaatgaccgcgccacccgcgtatccgccgtattgaaccccgtgaagctcatcatcaccaactatcccgaaggacaagtggaagagatggaagccgtcaacaaccccgaacatcccgaagaaggcaaccacgtcatcgaattcagccgcgaactttggatggagcgcgacgacttcatggaagatgctccgaagaaatatttccgcatgacaccgggacaagaggtacgtctgaagaacgcgtacatcgtgaagtgcaccggctgcaagaagaacgacgccggtgaaatcaccgaagtatattgcgaatacgaccccgataccaagagcggtctacccggagccaaccgtaaggtgaaaggcaccatccattgggtaagttgtgcccactgcctcgaagcagaagtgcgcctctacgaccgtctgtggaaagtggagaacccgcgcgacgagcttgccgccatccgcgaagcgaagaactgcgacgcactgacagccatgaaagaaatgatcaaccccgactccctgaatgtgctgccctgctgctacatcgagaagtacgctgccggcatgcagcccctctcctacctgcagttccaacgtatcggttattttaatgttgacaaagattctacgccagaaaaaatggtattcaaccgtactgtaggtctgaaagacgtttggggtaaaatcaataaataagaatatgagtaaaaaaaacctgctgtccggaagagacaaagaactgcaagaaatggcagaacaatatgaagctgccaaagcagagaacagaaccatctatctggacgcagacgacttagccgacctcgcagactggtatgccgtgcatcataaatatgccatggctaccgaggtcgtagagtatggcttgggaatacatccgaataatacagccctgctggtggaacaggcatacttgttcctcgacacccagcataaagagcaagccaaggatatattggaacggattgccgaagaatcttccgaagtgaaagtgctgaaagccaacctactgttgggcgaaggcaaagaagaagaagcggaagcgatactcgatagtatagacgataaggacgacctagccaacatcgtcgatgtatcctatatgtacatagacatgggattcccggaaaaagcattgacatggctgacgcgcggactcgaaaaatatgccgaagaagaagcctaccttgccgtcactggcgattgttactacgcccagggactgtttgaaaaagccaccttcttcttcaataagctgattgacaagaatccgtattcagctccttactggtttggactggcccgttgctactttgaccagcagatgttcgacaaagcaatcgaagcatgcgactatgccacggtggccgatgacgagtttgccgatgcctacctgatgaaaggacattccttcttccaattgggaaatgaggaaagtgccatggagaactacctgcaggccgaaaaattccatcttgtctcccacggtttcatcaacaccttcatcggcctgaacaaagcctccaaaggagagtggaaagaaggatacgactatctggaaaaagccataacggccgaagacagccatgacttcgccttgccctccctttatgccaatgcggccctatgcctgcacaagatgggaaagaagcgcaaagcccaccaatattgtaaaaaagcatacgacctgtcacccgaagagatagacccgtacctgattgagggacgcatctacatggaagaaggtgagtatgagaaaggtgtgaaaaaatgggccaaagccttagagtatgccccctatgcggatacctggcacgaaataggcatgtgtagcatggagataggacaactaagctatgccaagctggcctttgaacatgtcaaagagatggaaccggactttgaaggtatcaacgaaaggctgacctctctgtatatgctgctcaaagacaaagagaacttcatgaagtacaaccagctgtgcgaacatccgttcaggctggaagagctggacaaattgcaacagatactacaagaagataatcaggaagagctggccctagtaatgaagaatattttcaatgcattacaataacagtaattatataccactaatctagcaaatggaatcagtagcctttatccaatggtgtctcgaccacctcaattactggaccatcactttattgatggccattgaaagttcgtttattcccttcccttcggaagttgtagtccctcctgccgcttggaaagccgccaacaatgacaacatgaatatatatctggtggtattgtttgcaaccataggggcaaatatcggagccttgataaactactatctggcaaaatggctgggacgccccatcatttacaagtttgccaacagccgtttcgggcacatgtgcctcatcgacgaagccaaagtgcagcatgcggaagaatattttgacaagcatggagccgtatcaacctttgtcggccgcctgatacctgctgttcgccagttgatatccatccctgccggtctggcacgcatgaaactgggaactttcttgctgtacactaccttgggtgcgggcctttggaattccatcctggctttcatcggatattacttgtccacagtacccggcatcgagaacgaggaacagctgcttgccaaagtaacggaatacagccatgagataggttatgtatttatcggcatcggtgtactcatcgtggcattcttcatctataaaggaatgaagaagaaataaaaaagaaaacggcatgataataaaaaagcggtggacagcatgataaattctgtccaccgctttttattgcttatcccagatccaaactttctactttacagttgcaatagctttatcatagtctggttcttgcgtaatttcaggtaccaattccgtataggcaatcttaccatctttgccgataaccactaccgaacgcgccaatagacctgcaagcggtccgtcggccatgcgtaccccgtagttttcatcaaaatcggaaaaacggaaatcagacaaaggaatcacattctcaataccctccgttgtacagaaacgtgcatgtgcaaaaggcaagtccttggagattgccaacaccacggtatcgggcaggccggcagccagttcgttgaacttacgtacagaagtagcgcacacaccagtgtcaaggctggggaaaatattcaaaataacattcttcccgttcagttccttcaaagagaatgaagacaaatctgtttttaccaattcgaaatcgggggcaacagagcccacctttataaattcaccgataacctttaccggttgtcctttaaattttgttgtagccatagttttatcaaattatatgtatacataacaaattacatacagaaaaagttcacccgaaacttttttccggataaactgttattctacggacgaattaatgataatcacttaaaaaattaaattcacatgaaaactatttttgacgaacttcagcaggaagtaaagaattggtggatttcactcattcttggtattctttatgtaatagtggctataagcctgatgttctcccctctcagcgggtatgcggtattgagcattctgttcagcgtctccatgttgttcagcggtctgctggaaatatcctttgcagtaagtaaccgtagaagggtatccagttggggatggtatctggctggaggcatcatcgacatgattctgggattctacctgatagcctatccgatgctcagcatggaagtcattccgttcatcatcgccttctggctgatgttccgcggcttctcatccgtaggctatgccatggacctcaaaagatatgggacaagagactggggatggtacgttgctttcggtattcttgccgtcatctgctcgctcatcatcttgtggcaaccggcagtaggcgccctttacgccgtgtacatgatttcgtttgcattcctgattataggtttcttccgtatcatgctgtcattcgagctgaaaaacctgcacaagcgcgggaaagagtggaaggaaaagaaagaagtatcagccgaataagtagcccacacgaagcgtgtcaaaaggaatcccacctttgacaccttcgtttagctgaattgctcaatagtgtctcagaaaacggaacatcgtagtccgtgacactcccatctgccgggcaagctcagcacacgactctcctctttggtgctcccttacaagcttcctcttgttcgcatagagtatcttcattttgggtgtgtcccctttcttcctgcccagatgttttccttctttcctccgtcgttccaaggcttctttggtgcgcatggaaatcagattacgctctatctcggccatcagtccaaaagcaaatcccagcactttgctattgatgtcattctggaacacatacccctctttggtactgtacagcaccactccccttttgatgcaggagttaagaatggtcattatctccagcagtgtccggctaagccgcgaaatctccgttataatcaaggagtctcccggtttcatccggtccaacaagcccgccagtttacgctctttgctactcacttttccgctgaccgtctccatgtaccatctgtcgatgctcaacccgttcttctccgcaaagcgtataatttcctcgcgctgattctctaaaaactgtttttctgtacttactcttaaataagctactactgccataattgataaacgtttattggttattattcaccgccaaagaacggttattcaaataagagtggcaacacacaactatggctctctatcacagaagatcacattatggatatcccccgaagtcagagaagattctcggtacccatctcaaatatgcctataaacaaagaaaacagccccactgaagctgttttctgaaattagttcataaaaaattgatactatgtagatttcatagtatactctccttcatttcattcactatgtatctcacatcctcatccgtcacataaggaccactcggcaagcaaagaccacgcctgaacaaaccctcactgacaccattcacataggcaggattagctgcataaaccggctggagatgcataggcttccataagggacggctctcgataccggctctgtccaagcaaatacgcatggcttccacattacggttgggctcacaagaggtatgggcactcattgactcatgcgtaacacccgcggcaccaccaacggcacctttcactgtctcacggtaggcatcctcctcacctctcacatgcagattcccgtcaagcagtaccgtgttcagccaataattgctgtcataacgtccggaaggattctcatgaaacgtgattccctccacatccgccaacagctcacgatacagaccgcacagatgcttatggtgcgctatgtgctcatccaccaccgtcatctgaccgcggccgattcccgcacaaatgttactcatcctataattatagcctatacgctcatgctggtagtagggataggactcacgggcctgggtagcatagaacattatctcacgtttggactcttcatcagggcaaatcaaagcaccgccaccactggtggttatcatcttgttgccattgaaagaaagcacaccatatttgccaaaagttccaagaacttgcccgtcaaacttgcttccaaagccttcggcggcatcctctatgaccggaatatcatatttatctgccaccgacataatttggtctatcttgtagggcatcccatacaaagccaccggaacaatcgctttgggctttcggccgatcttgtcgatacggtccctgatagcctgctccagaagaagcgggtccatgttccaagtatcagcctcagaatccacaaataccggagtggcaccgaggtaggtcaccggatgggaagaggcacaaaaagtgaagctctgtactatcacttcgtcaccctgactaactccgcaagcaagcaaggccagatgcacagcggcagtaccggcacttaaagccaccacctttttattctgccccacaaagcattccaaatcctgctcgaaggcatccacattcggtccgagaggaacaacccagttggtatcaaaggcttcttgtatgaagcccatctccttgccgctcatgtgagcgaggcaaagatatattcgtttgtccataaagttataaatgaatttcttttcaaagaagtgcaatgaatattatgaagatatctctctttttacataatatggaattagcaaaaaaacaaagattttacagagctttttccaaagccgtttcatatctaaaactatataattgcttcttttttagcaagggttactttctcaagatgtcctggacataatatccgagactcagccaatcgaattattagtgctttcgatttatccgcctccttcttatttccattgggaagattagttacaacattatatcccggtatatatgaatccccagaaaaaacatagctccctatgagataagtaatgcaagttggactgtgccctggcgtttctattacctttgcatttatcccatctaataaggtaatggaatcttcttcacgaacaactttaatattctttcctgaatatattattggtttatcatggtatttagatagattcagttttgcggaagccaaagcctctacacctgcttcgttagtatagattattgcaccaggaaatatccgtattaaagcaggcaatccatagatatgatcatagtgaatgtgtgtcaacagaatacccttcagcactttgccgtcacccgcagtctccataatttgttcaatatccccaggatcgacaatccagaattcagttctgctaacttcaagaatatatgttcttgattctaaaacagtattgataatggattttacgattagcattatattaaggatattgagcaaaatcaatatacatcacaattaacacccgatacatattgaatcaccgactatcagtacaatcttctataattaaaaatatattatcaataaattgataaccatttcctccatgctggaaaattgttgaacatatccgtaaaattatcaggatttttaaacccttcccaatttctatattttttaggcagacctctttgtgcaacaaatgaattataattcaagcacttacctttattcaaggaagtaatatcagccatttcatcgacactcagttcaaagtctaaaatcgaaatattttctttcaaatgaactacattccaagttttaggaatcacaataatccccctttgaataagccagcgcaggactacttgaacggtgctcttaccatgtttttttgcaattgccaaaatcaaaggatgttcaataatctccagtcttggttctactgaacggaaatggctaaatgtcgacatagattcaactgcaattcccctatcctgacaatattttattaactcaatctgagcgtttaacggactaatttctatttgattcacagcaggaacaacatccgaaatctcactcaaagcttcaatatgtggctgcagaaaattggaaaccccaatagccctgattcttccctctttatagaatttctcaagaaccttccacatatccatgaatattttccaaggattatgaatcaagaacaagtctatatattccgtatcaaggttatcaaaagatttttgaacagcttgttcaatactgacattattccttcgattaagaattctatgaattccatacttatatcctccacagtaaagcgcatcaatattcacttttgtagtaataaacacatcttcacgcttgataccatgttttttgaaaatccgagcaatatcagcctcgttataatatctccaagctgtatcaaactgtctgtaacccatgtcataggcttttatcagagtatcctccagcttatccttcggtataagaaatgttcctagaccaatttgtggcatttcaataccattattcaattttatatattgcatatccatataattattagttcatatactatttccacgcttgcattttataccataaaccacatccagatgcaatttgagttatatcttctcctggaggaatattaccttctaacaactctatcccattttgagctatagctaaatcccatccaacgtatcttgcatcaggttcataataaacaatttcttttataattgagatacattcatcaaaatgtggaataataaaaccatcaaatttaatatgagaataaggatgaacctcatatcttgcacagttcatgccataagcatcacctttcaaaatgcttttttcagagtctatcacacaagccataccaccatcatgataattatcagttaatgcaaccccattgcccatacgcaataatgcggccagtatgtgtaattgtttttcccgatctaatacggtaacaatacgaatcgtattcaatgaacctggcgctaagttctttagtttctcacaatttgttataatttcctctattataaattgttctccagtaataatcttttgctccaaaatatctagtacatatttatagttatcagaagaagtacatattctaaatacaccatgccctccgtaatcttttaaaggtttagcaataacatctctatattgaattataaatttcacaatttcatcccagctcttatttactgttgttaaccatcccctatttatatatttccgaaatcgttgattaaatttagctttatcaagaaacaattcatacacttctggagtactaaaagtatatcttagaacatcatttctgcgcaatgatatatatgcttttcgttcagctattgatttattccaaaatgtaaaagtacaatagtcattaaaatcattaccataaaaaatataccaatataataaatcaacaaatacactgaatctactttttgaaggacattgttttatgacaaatgcactattatcccaactatttcgacaataattcaatactgttgatatacgatataatttcaacttccttactattgcattcatatgccaatttttcttagtattccaccaattcagaaacaacaatattatccacattaaactccatacatgcccaagcaagtcctaccccaaatccacaagccaagcaatggttctttttgttacataatgcttctgcagtacgggtaaccatggtcaaaggaatggaggcacttgtcacattgccgaaatcttccaagcaataaggaactttctctgcaggtatcttcaccgatttgcgaatcttctcgtcaatgaatttatttgcttgatgtaaatagagataatctatttcatccacattgatatgataagcctctataagttctttcaacgaacgaggcggtgtcttgatagcaaacgcaaacacatccataccattgactatcatatcagttcccttgcggacaatgcccggttctatttccttttcaacaaccgcttcaacagttgtcggatatcgcattcctccatactttgtccacacagcctgatagccagaaccatccactccaaatacaaaattaaaaggtttgccgaatgaagcatcatattcaaatgctgttaccgtggcagcgtcgccaaacaaaggtttaaccgtcctatctttagaatttcggttgatggaatttgtctcagctgcaatcaacaaaccttttttaaaagagccatgtgacattaaagagcctatcacactaatcccataaatccatcctgagcaccctaaaggtaagtccattacgtaacaatcgttacgtaatcccaagcggttttgaaggatacatgctgtttgtggagcaataaaatcacgagatgtacatacataaatcaagcaatccacttctgaaatctcccaactcaaatcggtcaatatccgatgaacagcagctactgtaagatcagatgctgtcgttcctaattgtaccactcgtcgcctttcgatgccagtcgatgccataactttctttgcttcactttcatccttgaaaataggaagtgacaaattttcttctacccgtgatgggacacaagctgccattcctgctattctcacatttctgattgtcaattgtgacataaagctaatcgttgtttttttcccgatgaagtcattggaattttatcaatccattcaaacttcaccggcattttataattctcaattttgtttcccaacaatgtatcgatttcttctaaagatttggtagttccctcccttagtacatatactttaggcacctcaccaaccaatcctcttggatctttcattgcaacacaaatacagtccgatacacctcccaaagctataattgcatcctctatttcaataggactcactttcttaccaccgacattaatcatctcttttttacggctcaccaaatagaaattttcattttccgatttatatgcataatcacctgtgcggaaatattctccccaaaaagaatctacagtatcaccgtccaccagataagacttcatcaccatattcccctttatgcacaattcaccggattctcctatcggaagttccagaccttcatcactgaagattttcacatccacctcctttgttacaggctttccgatagtaaccaaatcgtcagcatattcatgaaattccataaagagtgaacgggatgcctctgtcaatccgtaatgcatacaaatacgagtgtttggaaacatttccatcagtaaccgcttgttctccacactcattgccgcactaccaatttcaatataactcatctgacttgcaaactttccaaaaacatttccactcaatttcttgatatactcccatacagcaggtaccatgcctatccctgtcacatgatattgttccatcgtgttaaacaataactttagattagcaaaactacccaataagataaatgttgctcctaacaacatattacaacgtaatctacccaaaccaaacgaatggcaaataggtaaacccaatacctctacatcatcggctgtattcccgatatatcgattaatattattggcagagccactaatattggcatgtgacaaaagcacgccttttggttttccggtagtaccggttgtgaacataatatcagctatatcttgagcagaaagcagtccgatgtcagcaggttttcccaccaaagaaacctcagaatacccaatacctcccttaagaccaaagactcttttcggacgaaccgtttcaatgatatatttttttctttcctcattcgaggtcgggtcaactatcacattaaccagtcccaacagatgagcagcaaaatataaatatacaaattcaacatctttcaaagcagaaagtaaaatacagtcacctttctccaatcccaatgattgaagacaagccgccgcaccaagtatgtttttccacagcaatgcataactcaccgaaacgccctttgctatgatagccgttttatccgcactctgcaccgaataccgataaatagcttgcagtaattggctatgtgttaaactacacattcttcaactcaataactttatttacaatacttcctaccgtgtttagctcaaaaaggtcttctactggaaaatccacatttaattcattttcaatagtcgtaagaatagccacgttacccatcgagtcccattgttcaatatcaccggcagccatttccatagtaatcactgattcttcaacattcagtgttctagcaattactgatattatttcacattttatatccatttttattcttagctttaaattgacactccaccatccaacaccatcgaatgaccagtcagccacgaggaggcatcagacagtaaatacaccacaccatatgcaatgtcctcaggtactccataacgtttcagaggataacgtttcatatcctcctgtaattgctcttcgctgactgtacctctatgaattaaaggagtatcaaccatccctggacaaatactatttacacgtacttttctcgatgcaaactctttggcacaaaatttcataatggaattcaaggcagccttcgatgcaccgtaaatacagttaccaccgctgaatacctctgttccacccaatgaagccaatatcacgacagccccctctttattgatttgcttctttttataaagcacgcgcattaattcaataggagcataaaaattggtctcaaaaatatcatcaaacttatcacggctcgaaaactggaacggcaatgtcagtcctttacccgaacaaagcaccagtccatctatcttaccagcttcagatatcagattttccacttgttccaccacctgcaaatcagctaccacaaccttgtgtgcctgcccgttcttcacatccaaatcagcaaacgtagcattgagacgttcttcattgcgtgccgttataataaggttagcccccatcttggcacattctgtagcagtagcttttcctataccggatgaagctcccgtgacaagtattgtttttccctctaaagaaaaaggattataatgcaacataacttttaaagttcttgtaattcagaaatcactaaattttcatctgtatgaaaaagaatcgtcccccatgaaagtcctactccaaaaccacagcctaccaaagtaactgcttttccatatagctgttccctcaattctgtcacaacagtaagtggaatggatgctgatgaagtgttgccaaaccgtctcaagctataaggaactttttcgtccgtcaatttcaactttttcttgatagtttcgagcatttttatgtttgcctgatgaaacaatacataatccactccatccatggtaataccacactctgcaaatacctttttaatggatttaggagcagtggtaatcccgaatgcaaatacatccatgccgttcattctcgtttgacaagcatgacgcttacgtccatcctcgcaatcctgcaactctaacgaagctggcgttataggattacgggccccaccaccaggacggattatcgcatcatatccagttccatcacttcccaaatcaatagtgataggttttgccttttcatcatattcgagagcagtagcagtacctgcatatccaaaaagttggtcgtgttcttccggaacttgtttacgtgcatcaccagctaatactatagcacgttttattctgccacaagtcattaacgagagtgcaactgacattgcatatacccatcccgaacatccaagattaatgtcaaagcagagacagcttttctttaatcctaactttccatgcaacacacatgctgttgctggcaatatataatccggagtttgagttacaagcatcagtaaatcaatgtcttcgttttcccagttcaaatcccacataagcttttttgccgctgcttcacataaatccgaagaagtaaattcattagaaaaacgtttttccctcactccaacagactcaatgtaagcttcgtcatcatatttatctgttgtagatacagtctttacaatgtttcttggaacaccagctgcaatacctgctatacggatattatttatatgaatgatagccatattctttttatcaacaagcttattaaagtttacttgccacagtgttataaatatccgctattgtttccgattttttaatgtcgtctccttttagagtcacatcatattcctcatccaccatggcaatcacgctaagagcaactaatgaagaccactcctcaatctctctaaagcgagtttccggagtaaatacactttcttctgtttcatcaaactgagcagcaaaattgctcacaaattctttcatttccataaactgtttttttagtcattacttatctttacacctatagtttcaatactttcgccggtactcctaaatacacatttccttctttaggtttagtcataagcacacttccggcagcaagttttgtatcattttttatttttagttgttgcaatacaatggaacccactccaaagaaattacagtcgcccatcaccacttcaccggatattctgacagaaggcattaatacattgtaatctcctatcttcacatcatgtcctaagacaacagccccgttgaatatattaaagtctccaattattacatcacaagatacgacacaaccgccttgtataatgtttcctttccctattttgaaggtctcaacatcttttatgacaatattaggggctataatattaggaaactgaacatttgtattgcttattaacgaagagagtttacgaagtactttattgttagcaattgcaaaaaccacactcaaagacttattccatgaattgagggtatccattcctcctagcactttaccataatgcgatatttgagtttcacattctactccatcatcaaaaaagcctatcaaattccactgaggcttcacctcatttatccaataaattaagcaagcaatctctttaccgaaaccacctgcaccatatatagcaatatcattcatgattaatcaacttaattatatccatcaaatggaattgtagtagcttgaccttccttggaaatactatccctcataaacactttcttaattgttagaaaaaaaattttcacatcaagtttcaaagagcaatggtctacataccacacgtccaattcaaatttcctcgtccaagagatagcattgcgcccattcacttgtgcccaacccgtaatccccggacggacttcatgacgacgagcttgttctttactataaagcggtaagtattgaggtaataaaggacgaggacctatcaaagccatgtcccctttcaatacattaatcagttgtggcaattcatcaatacttgtagaacgcacaaaacgccctaccttagtcaaacgctgtgcatccggcagcagattaccatccgtatcccgttcatcagtcatcgtcttaaactttatcacttggaatatctttccatcttttcccggacgctcctgagtaaagaatgctcctgcacctttgttggcaaaatgtaaccatagggcaaaaagaaggagtatcggccaaatcaaagccaacacacaaaacacaaggatgaagtcaatcactcttttaaaaaaatgagagtacatgattaaaaaaataaaattatgtgcgaaaggactgtacagttcatctcgaatttatcttcatcagataattatcgtaaccattctattttccgccacgacaattttatcggctgtttttcagccgataatgcacctatcagccactctaaaataaaaaagttctgccaaaaacagcagaaccaagaccatccaataatacatcatccgtttttgattatccagtaaaaccaaagctgaatacatgtaaatcccaaagatacaatacccagccctatcaatatgacatctaaatatacattcattctatcttgaagttttccaatacacgggtcggcttccatcccaattcacgcatcgccttttcgttactgaaagtaagcgattctgtgattttcttcagtttcaaagaattgataggcgctttctttcctaagcaatctcctaccaaagccatacatttagctgcccaataaggtattgagaaaggcatttttttattcagctgtttgcaaataaccgcttccaactctctgaaagaaggatggtaactatcacatacattatagacacctcctttttctgccaacaaaggaaccagacttgctatatcctgtaccatcaacacactcttccgcgcacgacttccggcaatacctaaatatcttccattgcgtatgccttgaatcatcgctcctaaatttcccggaggattacacccagcaattaaggaaggacgaataatacccaaaataacgttgtgtttgtagcaccatttatgcaaaaactcttcggccagacgtttgctcatggcatacggagttttcccacccaaaggatactcttctgttatctcttctccatactcgcaaccatatacggctactgtagaaataaagataaaagctcggggaacccctcttctttccaatgctgcacaaagattctttgtaccttgcagatttacatcaaaaaaagcttgtttctctgctttcgtcttgggtgtcacatgtgcttttccagctgcatgaagaacgatatcataccgttcacgcagctccggtatctcctgtgccatgttcacggtatagtcatcctgtggcaacagacctacagtagtaacctcatatatagcttccaaaagaggatgcacgttgttacccaagaacccggaggcccctgtaaataaaagtttcatgaaaattaaatagaaaaaattaactcaaaagaaaagtaatatcaaaatgctgttccggagtcataacaaaattccttccccatctcaactaataacaacaaatcaatgtcgctatccgaacgtacatcaccacgtgcctcgctcccataaagaataaccttcaaatcaagaaagttacgatgtaatgcttctttatattaatgatacgacatgtggacgactcatagaaactttgttaagtatggtgacaaagtttccgtaagtactcaatttagggcataccccttaatgaaagcacttttcagtgccctaaaacgagttttgttaattaattagttttgaatttaacattggctggtagccaaagtgattttgccaggaaccatgttaacataatccctgcacccgttaaaaatatttttgaaaaaagttccaatgaagttccagatagaacagccatgaagctttacagttcctattacactatgataagttacagccatcccagcaccggaatcactgccataatgaagggaattgttgcgttgagtggtcagcttccgaagtaagcccggcttcatcataaacatgttctttcaaaaagaatctctttaaaaggtttgaaaaacgcccggctaccggttcaccgccttgattaccggctttaatgaacttgttgtttgcacgagacatgcaaacctgatgtatagctgatttcagctcattgccgataaatacataagcattgtatccgtcagacataatactctttaattccgaatcacccaagaagtctgttagtacctcacgactgcgagagtcattctcatagaagaaaggctactcccatcgttttatacccgtcgggacgattgcccaggtcacgttccttttggggaagaaccggcctattccgaaatttatttttgtccagagaatctgtacggagtgtatcgtccgtaccgtcatatttaaacctttgatttacaaacacaaaggcagcaaaacaatctcgaaacctcaagtaaacaaacctattcgtctgattttttaatattttaaccataggaatctcaagtatcagaattacatctttccagtcgatccgataaaccgtatctgccccattccgctctactttcataaactgatagccagcaacaaacttcttttcgaacaggctgtatgaacggttgtcaaatgaaaacatacggactattctccgatttcgagacaacgcatatcggcaaagtcacggacataatagaaataattcagaccagttacattcaatataatctcttcagtttctctaccatgcgaactaaatcctgataacttaaattcttttgggataaacgcagcctattgctgatacgaatctcaagccaaatacgagcagaggtatcattactgctttttgatgcaggggtaggttggtcactagtcctgtttttttcctcataggtaatcacagagacatcatcaacccagactgcaaccacttttttgcgagtatccttaaaccatttctggaaaatgttataaggtactttgttcctaacacaaaacgattggagagattctccatgaggcaagcctcgctctggtactgaaaataaaacctttcaagatattcactgctatacataattctataaatttagttggcagcaaaattattactttcaattaatagccattttttgactgcttactcatctatttgtttaatccacaattccattataaatcctcaaatatccatctatcatattatcaacagtcagcttcttttgatagctttttaaagcgttttttgagaaacgggtataaacatctttattctctaaaatatagcagattttctcacagaaagctttcgctgaattctctactgtataaccattttcatcatctaatacaatctcgctaatacctcctacttttgaagcaaccaccggttttccaaaagccatggcttcaataatagtcatcggtaatccttcataattactgggaagaataaacaaatcagcgtattcattatacgcgcccgcattgggaagacttcccatgaaaaacacattttcagaatactgtccacgaaattcatgctgattaccaatccaaacaaaggcatattgaggtaataattcagaaactttcagaaataagtctatattttttgggggagataatctggcaatacataatattatctttgaatagcttcgcattttattaaagggactttccggtaaacgcaatggttgactaataccattatatacaaaacaaacattgttatttatcccctcattacacaaattatcttcatcatatttacttacaccaataatagttctacacctgaattgcagcatcttttcgaggaataaatattttcgatgggctatacgtatagaatcaaagccatgaactgtatatactatttttgcagaaggaaatgctattcggcctaataatccggcttttgatgaatgcaaatgaattatatctgggtgatactttttataaagtttccgcatagctcgaattgtcttgatttcattgagtagagacaaagctcttcgtaacgatggaatgcgttcacatatcacagacggatgaagcaacaaccacatttttccgtcaccagctcccgccgccactatcacctcatgttctttaaccaacctatttgccagattgacaacgaccgactgtgctcctccaagatcacagagagttattacttgaagtattcgcataaaaataacgttcaaaaatgacgtataatataatttacaaaatcattaaaaagtctgaaacaatttattatagaggtataggaaaaaataaaggcggtatcttaaagcataagtcatgcctattgcaatcagattttttctatatacagcatgccgtatggcattatcatagtaagggtttttcagttctttattaatctcgcggcacacctctctatattttttattttcaaagaattgagatgcagctaccgtagccacttcatgcgtaacaaatcgatataactgctctttaaagtcatatttagacatatcaatttgtttttctaaatgcctacctataacttccggagtattccaagggaaagcttttctgcattttgtcatagacgacggattcattctataataataaccgcaataatccatcactactgcgtttcgagcaaagttcataaatgctatcgtacaggctttgtcctctccaatcttcagaaacaaaccttgctgttgttgttgttgttgtatgtatatatcagatttaaatgccttaccccacaattgtcccggcagacaagcatcatcattccttctcataagtagaggatagatttccttcaccaattgttcttcattataatagcctgttcttaacgaaatccttcgatacttgtgattggtttccaaagcaaaaacatgtcccatcataacaatatccggatttttatattgctttatgctatcagatatcaattcaagataacgggaatctatccaatcgtccgaatccagacaaatacagtaatctcctcgcacttcatcagctcctgctattcttgcactcaccaatccaccattcgctttatttaccaaccggaaacggctatcccttaccaaatactcctgacaaatggtcaagcagtcatcggttgacccatcattcaccataatggcttcaaaatccgaaaaagattggttcagaacactgtcaaggcattgtctaagatacctacctgtattatagattggaattataatactaaataaaatcatactaaactattcattacaatattaccatcttgaactaacatgtaatccgaccttgatataaagccttagcaatgctatcatctttgtatccagcagaaaaagcaataatctgtctttcattccgattttagttttatcaccccccgatatgtttggaaaaagagagatagagtatttgaaagcttcttcattgtagaatgatgatttcatagaatgtacttttacataaacctttgccagggataatacgggtgcataatactcaagatttatcttcaaaaagaaatcctccaacagcaaagcggctctttccagacttttaatagattttacactcacagatgcggtataagacgtagctatatttttaagataataatagcacgttttcttcagatatgccaccttattggagttataaaccagtcgtggactggtagcatagtcttcactataacagatgctttcatccaattcaatgccgttatacacttttctattacaaaagcggaagcagagttcaaacctcgtctttcttataatcatttgatacagatactgctcttttgtttcaggcatggataaagtaatgtgttttgtgaagttgtcatataattcgtctatgtcaaacaccaccatatcggcattttcatccaaagccttgtttacaagacattctactgcatctgtcgagatatagtcatcgctatcaatatgccatatatactcaccttgggcatgcgacaagcctgtttttctggcagcagtcagccccttgttcacttcatgatttattaatatcacttgctccctccgatgtggataatcagtcattttatcttggatatgcttcatgctattgtctatagtacaatcatttacaaaaatgtattgcatattttcgtaagattgcgaaaataatgaatccaaacatttatcaatgtagcgttcaacattgtacaccggaacgacaatagaaactaaaggttctctatttcttaacataatcatttaatataaatataaagttcaccgttgggattaacattattcatcacccagttatcgtcatagtccatggaaagagccacgggatatggactgaataaatagtaccaccttgttatggtatgttttctccattcaagcatgaatccgaatagagtaaggaatacataggttttaaaaagaactttcagtttagacattcccgcatatttcattaagaaaaagatgccgtaataatagaaatatgccatcactctaccatttacggcaaaaaatgcggaagtaaatgccgtcagcagaaataaattatacaccaaagatgtctgttttgttataggaacattcttgcagaaaatagcaaaaaacaatatattgcaagtgtaatgtcctatcgtaggaagccaaaaaaatatattatgcccctcaagatattcggtagaagcgtattctccctctgtataactaacaagataatcatttaattctcctaaaggaagaacggaaaccaataatccaaacgattgcgaaacaaaaaaaagaattccaaaaaccaaatagaaaatgggcttatgccttacatacaatccaacctctgccagcagaatgagtggtatcaccatcatgacaccaaaatgaaagaaaaaggcaattaataacagccctatgtcaataaaacgtttttcgttcagcacatagtgtctgaaaatgtaataacttactaaagatgctgcaaaagagcttctcaatcctactgcaacagcagcgtagggaattataaaaatcacgaaccataaaaacacacagcggtctctatcgttcggcttcatgcttttgcaatagctattataggcatttaagaagagcattgtagtgctcgcaacaagcaagaacctcaaaaatccaaaagagataccatattttataaaaataaattccaacaatggtaataggaaatccacttttatgttcactcccaaaaagaacaagaaatcgttccactcaaacagctttatgtcttgaaagtttacccaatgcctatacaaatctgctacgggaggataaagcaacatggcgcataaacccataaacaatgaaaaaagaagatacatattcttcttttgccgatagcagccatttatcaccatgggcatggccagtacagggcagcaaaaaaaagccacccacacaaaccaatcagttcggattaagctcctcaatttcaaattgtccatatacattcaataattccggatgacatttaaacccaagaagatgttttttacattccttcgggaatgaaaagatagaagtactattaattgtatatgcatcggtaaagtacaaacctatcaaagaaaacaactccgccggcattttttttgaatataccattacatcgggaaacattcctctgtaatccatagtatctctgggatgtgtcttgattactacatcttctgcattgtattgattaattataccttgatatatctctctcatcacttcgtcacccacaccttgattgaaaggttgtgccagtataatcaccttcttttcgcgaagtttttctatttcctccttattaaagctgaacatatcaagaatataatctttataatcacacgtttcccataacttcctgatatcgacaagtatagctttttctttgagacaagcaggaatagatcccatagcaccggtaagaacaacttgtgaagcatatttagaattaccatactcaccataacacatgctggagccaaacagcaatctgtataaccacttgtgcttcatcgttgacggtcttactaaagcgctttctatatagtttgccagaccatcttcaataaccaccatagagcgtttgcgcaacagagccggagtgtaccacaggtgatcttgaccaaaaatcgggagcgtacacagaaaaggccatttcatataggctgtacattttaaccaaaagcggcataatactctcaacacaaacggctgtgaggtcattttcacataagagagaaattccttatacttgagtttactctgaaattcagacgagaatgcatctgatataaaaaagaaagtcttgtcaaattgttcctttccatataccagcatataaatgagcatggtatacgttgaatcaacaaaacatacagctttcaaatctttatatttcttcatctttattcttatttagatttattattctattcatattgtgacgtaatcacctcacgtatttattaattaatcctttagctctaaaaaccaccatcgccaccataagggctttaaggaaaacatagagcagacaggtatagtaaaggctgtatctggtaaacagcattgacagtcctaaatggagaacagagcaactgaatgttatgaacatcaaatccttggttctatcatagtagaaaagatagttggtataaagaaaatatatacactgaaaatatccggaaatgcctaataaataaaaataaggcaaggaagatgaatacttgggcaacaaaatagggataatgactgaacaacctacaaaaacgatgacagccccaattgtataaataacaaagatatcccttgtttggcgtttcagccgcaaccacctgtcattcgcttccgaagacaatatttgatagattgacacagaatttgtctgattaaatgccgccccaatcatatctatgatattcgaaagattgagtgcaaaactgaagattccaacttcggcaagggtataatagtaattgatgatatatctgtcaccgccttgcttaatccaactcgtagccaagtgtggaattaaaggaatgccccacatcaagataggctttacctgaagccacgaaagtcccttgaaaataaataggcgatagcgaaaacacacataaaaagctacaagtccatagagtactccgcaagcaagctgtgcatagatacgtcccacccatccctgcttcaaagcaacaacaaacagcatagttacagcgaaatttacaacggcaaagctgcaactcaccaaaccaaaagaagtcagtttctcacggatgcgataatagtcgagtacaatttgaaaatagcagttcatcacagaaatgactaatgcaaaccaaagataatgtatcggcaattctaacacttccgcaacaaaagtattacccaacagaagcaaaaaagcgaaaaacgtagctaccgcaaaagtgattaggaagatgagagtatagtcttgcttaaatttcttttcatcctttttaaagaaagaaatagttatgtaaccatgcgttgagagagaaacaacaaaccccaaaaaagaaatgatggtgttgaataagctcaaagtaccataatctgaaggagcaatataattggccagaataatcagtaacaaaaagcttgcaccctgattaaaaaaagagaaaaaagagaacaaagctcctttaagcagaagcttgttgcctaataaacaatttaaaaacattatttttattcagcagcagtgctacgcaatcctctccaccttttccacactatcaccggcaatatgctcagtgatacggtaagtattatcgtcagtgtagcgcagatgtatttattgcccacaaaatccagcaacattccatgtggaaagaatgcgaaaacaaacatctgaaggagaaaaatctcgaaggaatatttccccatcagacctataaactcttttagtttagtactcaaacgattataacagaatttcagaaagaaaaggaacaaagaggctacatagaagtagcatatccaatgatatatcttccagtctgtctgaaaaaataaaggttcgaaattaattgaggtataagcgaacatcaaaataaacgctatactgaccacagaaagcagcaatctaatattatccaagagaatacctttctccacccacatatatcccaaataaatcaaaaagaaataccggaaaaataaaagcctgtaaagcatctcaggtatgtggatatatatgcataccaactcccaaaggcagcttaacgcaatcatcagcaagcatattttaccccccctacaactttatttaacaatttgattatcaatgcaataataggcaacaacaacgcaaactgtatgtatatccacacatagtaggaaccaggacctataccgccaccaataataacagtcttcatcacctgcaaaggatctctttgcaataccactaccagcaaaaatacctcaaaaagcagtaagagaagaaaaggcttgaaaatcctattaaacagcttaaccaaattaggcattttcacagcctcgtccactccatgcttataggcatgaaagacctgtatcaataggaacaaaggcactgcttggtctccccaaagaggaaacaagatatattctgtgtgtggcagacagtgtgccaacactaccaagaagatacagactcctttgagataatctatgaaagggtcatatccctccttttgtaatgtaatgggtagcattcgttttatatttgtaagcactcaatttaaggtatcccccttaattaaggcacttttcagtgccctaaaccggtaagttctctcctgcttccctgaagggacatcaggcatatcgccaaatgcttatggaatattatcaccgggaagagtaccgtcaaaaactgataaccttcgacctgaacgaaaagacgctcaaaatcactgctactaatacatacttctatttaggtcgatgacagcagcaaaggtcgaaatctttagaatagaaaacaaaacggcatttttggacgcttacttttatatccaatttattggcaatctattcaacaacacactcatgccgttcgccaaagttcttttttccctatacacataggaaaatacttcacaagtagtagagtaaggaagtaacttaccactataatcaaaggaaactcaaaacacaacacagccgcccaactattggggactatgtgtaatactttgactacgggtatctgtgcaaaagggaacattgccaaatggacaccgaatattacaatggaatttcttccaaaaaacaaaaaaggcctatcaaaaaccaaataccgcctactcctaaaggattgggttcaagagcatctattggtataacagtaaagagtttggcaagtcctataaatttatccaaaatagaaaattcaaataggccttcaaacagatagcgtacacactgcaccaaaagttgcaaagttattccgaataaccaaaagaacacaaagggtactaaaagtgtattcactttcttgataaaaaagtccttaaaacaactccgttgtctgaaaaacaatccggataccaagaaaaaaagaggtaatcgtaaaggagcatttatcgcaactccggtcaaatcgaaatgataaagtaccacccaaagtactgaaaaaccttttatcgcatctatgtaatctatacgttttgttgccattgaatttaatataaattattccttacataagcacaatatctataaaaatattacattggggacgtcaacaattagcatccccagctgatatgcaaattaaaccttctcttactctctctttctcaccttcagccatccctccagccactcattcaccatctgcctgatttcatcatcctccaaatccatggagtagtaataaaaaagtgactgataagcacttaatctcacatccagcccttttttatttttccatacgtagttgtacaaatatgggcttctttggcaagagtattaatattcaagtctttctctttacgccatttctcaaataaagcacccagtatagggtggtcactgtttacattcatcgtcgtcttgtattatgttatcagaattaaaaaagtacatgttattaaacgttattttaggtttctcacatttaaaatattttccatatacagaaaatatttaatgagaaaagagccctaacttcgcacaaaatctttaaaacaacaaaatggaaaatctattcaaaatgtcacttttcatgccgcccatatcaccgataaaagacgaaaacaccggaaaaaccgtaaaaagtgccacactcaccccattcaggacaatgagcattgacgaagtacaccgtcttatcacctccgaccagagacttgccgaactgacactcgccataagaaatgccgcagcacaaggagacgaaactaccgcacgattcctcaaacaacagacactaccctacgtcactccctgcggcgtattcacccgacgacgaagcgactgcctcacggaatcctccggcctggttgtagtcgatatcgaccaccttgaatccgcagaagaaacggaaaacttacggcaacaactattcgatgacccctatctatgccctgcgctggtgttcatcagccccaccggacggggcgtaaaagcgtttgttccctgtcttcacggacagaatcctgcagaaggaatacaatgggccatgaactacgtccactgcatgtatgacaccgaaaacacacaacccggaaaaggagtggacacttcggggaaagacctcgtacgtgcctgtttcctctgccatgacccgaaggcactgctcagagaagttgtgaatttcgaatgatgagtcattgcaaatcaccgactacaaattactaattataaattaccaaatccgatggaaccactatcttcattgcaccttctggccgaagcagtcagaaatgcaggagcagacattgctccaacctatcaagaatatatacaactggcatttgccattgccaccgactgcggagaagcaggacggcatgattttttaagtctgtgcagcctgtcgtccaagtacgaccaacgggcagccgacaaactcttcagcaatgccctgaagaccggccgtaacgacgtgcatctaggaaccgcctttcatctggccgagctttgcggcgtgaagattcagcatgaagccgcacccgccattggtacacttggtacacaaagttcacccctctcttctacctcacacacacgcgcacgcgaggaagagtccgcatcgggcattgaaccactgtctccattacccactttcgacgaacacctccactggccttatcccctgaatcgcatcatgagctgcggaacctccctcgcccaatacgatgtactgctactgggtgccatcaccgtattgggtgccagtatgggaaaacacgtccgatgttcctatggaggaaaaatgatgtccccctgcctgcaaacctttgtagtagccctacctgcatccggcaaaggagtgctctccttggtacgcctgcttgccgagcccattcacgatgaaatacgtgggcaggtagacgaaagcatggcatgttaccgccgcgaaaaagcaaaatacgacacactgggcaaggaacgtggaaaaacggagactcccgtaatgcctctcaacaagatgttcctcatctcgggcaacaacaccggaaccggcatcctgcaaaacctgatggactccgacggtaccggactgatatgcgaaagcgaagccgacaccatctccaccgccatcggttcggaatacggacactggagcgacaccatgcgcaaagccttcgaccacgaccgactgtcctacaaccggcgcaccgaccacgaataccgagaggtaaagaaaacttatctttccgtacttctgtcaggcaccccctcacaagtgaaaccactgattcccactgctgagaacgggctcttttctcgccaggtattctactacatgcctgccatacatcattggcaaaaccagttcgaccgcaatgacagcgatcttgaagataccttcaaggctctgggcatggaatggaaggacaaactgaaaaccattgtcatgaacggaatattcacccttcaccttacggacggacagaaagatgaattcaaccggctcttctcccggcttttcgtacgctccggactagccaacggaaacgagatgtcaagcagcgtggcacgtctggccatcaacatctgccgcatcatggaagtggtggccatgctccgcgcaatggaacaaggggaaatcaccgcctcgccttacgtgtcgcccgaccctcacacagccacagacaatctgaaagaccacattgtcagccgatggaatctcctcattgcttccgctgactttcatgccgtactctcactggccgaaagcctttaccggcataccacccatatcctctccttcctgcccaacaccgaagtgacaagccgcggcaatgccgaccgggatgcgctggtagacagcatggaagaagaattcacacgggcctctttcctgcagaaagccggagagatgggcatcaaatcggaaaccgcctccacctggctcaaacgtatgcagaaacacgggctggtggaaaatgtagatggcaagggaaactaccggaaacccaaagtctgacattcacttcgcttcacgcacgcgtatgtgtgtgagacgaaaggatggatgaacctctgtaccaagtgtaccaacctgacctttacgccatccaacctcaggtttaaggctctccaagtgcagccactatcagctgcacttgggcaggcgtataagagcgggaacgggaagaaccgcccaaagcggaaagtccgtcacgcaaatcgggacaaaggtctatccagtgtttcagtttgcggaaggcagcctccggacaaagattgggacaatagatttgggccaattcggtacgcccgtatgtacgtatgacaaaagaatccatagttgacagttacgatttatatttcatcaaaagtaactataaatcatgacattatcaaacttacaagcgtaaataaccgactaaaacagacccaaacagacgagaacctgcaaaaaccgacaaacgcccgtatccacagccttatctttgcatcgttgagttcaacacagcaaatgtttttatcctttaacttctaaattttaattgtatgattcgttacaaaaagtatcaagtgacgggcgaagacagcccactgaaaggcctcaggtatgcacgccccgtaatcgaagaaaccttcgacatcgaaaaattggccaagcacatgtccaatcacaacaccccctattcgagtggtgtcatcaagggagtactggcagacatggtttcctgcaccaaagaattgattctggacggcaagaacgtgaaactggatgaccttgccatcttctccgtaggaatcgtcagcaagaaaggggcgcaatccgctgccgacttctcgctggccaacaacgtgaaggggctgaagctccgcgcccgtgccaccggcgaactgagtaatgcccaaatcaacctggatggacagctgaaagaatcttccctgtacaccgtaggtggaaaagctcccgatggcagtggttccgacggcggttccggaggaagtgacggcaatcagggcgagaatccgttaggatgagaataattacaaattactaattatcaattaccaatcatcatgagtgaagacaaaaagtcaaaatccgtatggggcattgtcctcaaagtaatcatcaccgtagctaccgccatagcgggagctttaggtctgggcgcttgcaaatagccatgcgtacgattaccctgctcattattcattgctcagccacgcctcaaggcgtggccctgggctttgaggattgccgccgcgaccacatccaccaccgcggcttccgtgacatcggctatcatttctatctgacccgcaacggcgaaatacaccgcggccgcccgttggaaaaaataggtgcgcattgcctcaatcacaaccgccattctatcggcatctgttatgaaggaggactggatgctgcaagttttcctgccgatacccgtacattggaacagaaggcttcgttactggcactgctacgtgagttgaagcgtatctttccacgggcgctgattgtggggcaccatgacttgaatccgacgaaagcgtgtccgtgcttcgatgcggaaagggagtatagggggctctaaaaggctcccttcttcattctaccatccgcactatctgaaatgcctcggccaagtgtttgcctacggtatagccgcgaaaccgggcaagggctttcaatgcctccgaagagcgcggatgcggaaaagcacggctctcaaactcataggccgccatggcagcacattttgctttcaaatcatcctccgaaatctccatatagaaattggctgtgaaatggcgtgggtcgcaagtagcctgccactcactggctgatggggtctcgaatgtaaaaatagccttcaccggttcgtcctccatagggcgtgtggcagtcatcactgcttgaaaagtcatctgatggtcaatattaaggtcgccaccatggtgggtaaagataaagtccggacgaaactgttccttctcatgctccactacctttacgatatcaagcagtgcatggctgtcaaaacggttgtcggaaaaattatatgcctgcacgctgtgatagcctatcaactgccgcgccgtctccacattctgatgatgcctttccaagacttccttccactgctccgtgtcacgggtatctgagcgtgaagtaatcccctctcccaaaatgatgacccgggtctgtactccttgtgccttgactagtttgtgcatggtagcgcctaggcccagcagttcatcatcgggatgggcggcaacaaccatgatacgtttatttgtaaatagagacataaatatattactgaacgtactccattttcattggagtaccacgtttgacatcacgattgacagttctacctagaagttcatccaaatatcgcggatgcaatccttgccctggccgaatagagcgtaagttattagccgtaagcgtttcgccggctttcacatcctcaacaataaacaaagaacgagcgaaacctctattgaaccgtgcatgttcgtttagttcatattgtacagtgcctaaagccttttctgtattacggatttcatctaccatcgtcttgaactcatccggctccattgagaaagcagcatcagggcctcccattgccctacttaaaatgaagtgcttttccacaatctttgctcctaatgccacagcggcaacagcaacagagtgtcccatagagtgatctgaaaggcctgccacaactttaaagcgcttggtcatatcgggaattgtcaaaacattagcttcttctaaaggagtgggataagaagatgtacacttcagaagagcaatctgattattaccctcgctacggcaaatatcaatggcttcttgtatgtcagtcatctcggcaattcctgtagaaataagaataggcctgccttttgaggccattctgcgaacaagagctgtatctgtaatctcgaaacttgcaactttataagcaggaacgttcatcttttccagaaaatcaactccttccaaatctgatggtgctgaaaagaactccatatccaaatcatgggcaactttctgcaatttgggcaaccactcccaaggcgtgtatgtttccttatagagtttgttcaatgtcttcccgtcccacaaagtgcctccaccaatttgaaaatattcattatcacaatcaatggtaatacctccgtctggattgtcattctgtacttttacaacatcggcacctgcctttttcattgcctcgatggtacggacagcaatatcaaagctctgcaaatgattacaagacagttctgccaaaaccagcgttctgtccagtttatcaaaattgatttctaccatatctatatctatgcaaatatactatatttagaatttgatgagttctccttcagagttagtaaaatactccaagtatctacgtttcatacgggtgccaaactgaggcgagacatggggcaatggttcgcctaacaattgtttaatgcggagataaggcaaatttactccacctgctgcaattacagataccgtagccgtcaaacgaggattaatatccattaaaactgccgttccatctgcactgcgcataaagtcaaaacccacattaccatccatgtgcattaagcgcaccacatcgctacatattttataagcttgcctgtcataagccaatacgctttcctgtgcaatactcataaggctaacgacattttcacggcctacctgatagattacagtacccttatgagccaaaaggtcaactgtgtattcattacctggcatgaactccaccaacataagctcatccagcacatccacttctttcaaaatgctcagcatatcatcgtaagaagtatagaaactgttgggcttctcatgggcgaatagctgataacgggacttgttcgcatcaataattcttacaccacggcttccactaccattgactatttttaggcatacaggtttttggggataacccatatacttacacccttcaacaaagtcattgactgtatggactggataatattcaggcaccggtatccctgcctctgcaagcatttggtatgtcttaagcttgttatttgccacatctacagaattgctgttggaaaccgacaaagtgacccctatccgcttgaaatcgtcccatcgtttcaccaatgcactcacttccgccgaaactcccgggaaatagatatctacatgttctttcttgcaaatatcgagcaatatgttacaataatcaggatgagtagctgcaggtacatgataaaaagcgtcaaccatatacctggcagaaggttcatcagacatatccacacctactaccctaattttacgttctccattatttttgaagcaagctatgatgccgggaatagatggtgagccactggcggaaattaatactgtgaggtctttcattgcttctctgttataaaagtgttgaacacatcatcaaaagtttctgcccgtttgattaccttaatcgtgccatcttgcgaataacacaacatttggcaatccggttggataaacggtggttttgatacgattgaatagccccccacattaccaaagagcaaaatgtcacttacagaaactggttccttaaagtcatgatataaacaatcttgttccaaacaagtgtatcccataatatctgtgattcccgaactataattcgcattgacagaacctgcagaatggaccactcgataaggcacttccttgaacttgcaaatttcaccggcattgtaatagcaactgtccacggttacaaattgtttacctctaatagacttgatattatccacacgggttgccagtgatataaactttgatatgagggtagtacccggttctgaaaacagaataggtttcttttctgaaccagaaaagaactgcgccatagttccagccactacgcgggcgtaatcatcataagtcggaacatgatccccaaactgaatagcgagagaaggatccatttgtccgaacataccacttccaacgtcaacgtagtctacggctccgtcaaaatagttagagatgacatccaataaaccgtcaattctattttgccaagcctctaatccccgtgcacgacttatatggcagtgtacaccgctcaaaacgacattgccgcatgcctttagataatcaatcgtacgtcggaaagattcactgtctttttccagaccaaaacgtgaaatgtatccagcaccaatatccatgttaacacgaataccgacccttataatcttgtttgaatgaatgcgggatatttcaatgacacgtaaagcttcatcctcactgtctatattagatatgcccccattaagaatatgctcctccatacaacggcctttacaaggtccgttataaataatctgactgtccggatagcccaatctttttgctaaagtatattccatatcggacacaacctcggcatatccccccatctgtttaactaaattacatatgtagggggtatagttggtcttataagagtaagaaggaatatagttatcgtaaacagcacggaaagagtcacataatgattggaagttttcacaaaaatctttttcatgaaacaaatagaatggggttccataatcatggactaatcttaggatttcactatccaatgcacttttcgtatcgggatccttggtataaaacggaaaatctaacagatatttattcataaaaacagtttaaaatttcaatacggttcccgcccaacttaatcctaccccgaatccggtcaccatcacgttcataccttcatgtactagcccacagtcgagacaatcttttagaccaatcataacagtagaagatacagtgttacctgtagtgtccagattcatatagaactggtctttgggcaacacacacaccttgcgaatagtattaagcataaacttattagcctgatgaaaaatgtaataattcacctcttccttacttaggttattctttgtcaaaacatccttcatcaaagcaggaacagcttcaagtgtaaagttaaagatggcaccaccattcatatagaggtaatcttcataagccgtatgcccttcgtcatcagtcatagaaacacccgtagattgcctctgacgcgatgctcctgtcttcacaatcagatgctcagccccactgccatcagtacccattgagaattcaccaatttctgccatcccctcagtagataccaaacaagcagctgcaccatcgccaaagatggaacggttgctcttatctgacggatgcagatatttgttataagtttcagcggtcaataataatacattactagcaatgccagccgctatcagcccttttgccactgccaaaccataaacacaacccgagcaacctagattatagtcgaacgcaccaatgttggtacgcaaacctaatttgtgttgcaagatacaagccgtcgatggcaggaagtaatccggactttgggtacagagtaacaaaaaatcaatattctgcgggtcgatatgatgctcactgaataattggtaggcagccttttcggccatatcaccagctgtttcgtcttcagcagccagatgacgggagttcacacctactttcgcagctactttatctatactccactcgggaaattcagaaactaattcttcgttagtcactaccttaactggcaagtagtatgaaatcgccttaatatatgccttcataattataatttattacaaattactctccccccccgtcaaatcgacattcgttcctgtcatccatgcagatgcctcggacagcagataaatggcaagatttgccacatcctcgggttggccgtaacgttttaaaggatattgctgttcagcttcttgcaagtcctctttagttagtcctccttttagaatcaaatctgtccacaccatagcaggacagatgcaattcacacgaatctgccgggaggccaattcaagtgccaaacatttggcataggaaatgagcgcaccttttgatgcactatagatagcattgccaatactgggtgaaaaagctgcacgcgaagctatgaacacaatggaagatgctttttttattttcttggcacgaagtaactcagcttgcagtaaagcgatagacttgaaattaatatccatcacctcgtccacatcgttttcggtaataagtttgcaaagctgacgttggccgatacccgcagcatagaccactccgtccaaagcaggtaactggttcaccaatatttgtcgttctccaataagagcaaggtcaactatgattgatttatgtccattaccaactaaagcctctgcagtagcggcaagcctttcttcattacgccctgtaagcacaatcgtagcacccattttagcacaagcttcggctatgccacgcccaataccagaagaagctccagtcaccaaaatggtttttcctgaaagagagaaagggttaaatacttctgtcattatcatttagcagccactaaattaaacagctcttccactgtgttgcaagaacgaatttccttgcctgtgagtgtcttaccatattctgtttttacaaaagctattatagccatagcagtcaatgaagaccattcatctaattcttgaaattgcgtattagcctgaatttctgatgcgtctgtgtcatcgaactgattaacaaagccattaatgaagttttctattttcattttttacaaattttatatattccacaatcgttttttcgtagtttgaatcaaaatcttcaggtgtaagactatcacacacataataaagtttcttcatactgcaaattgattctattgttttagaggaagtaaactgacagcctaaaaaaacatcaattaaataggcttgtacattatccgcatcgaccgaaccgtagaatcgtttaaactgtaatatatgaaagtaaaaatagaaacactcttttacaaaagaaaacccatcgccataagttccagggattgcataatagcctaattcaccacaatcctcatctttttttattgatgtaacatatgtaacaccaatgggatcaccatcaggatcgtaaactaaccaataataagcatcagctctattgtgaaggcttgctacataagccaaatgattatccaatggaataatctcattggaatacatccatttccttacatcaacatgattacgccaaaaaagaattttctttaacgtgtccatatctaaattgataaagttacgaaacctgtaaccatgcgaactataatctacatttctatctatttctatcattcataaaaaacattattcaaaaatattctttgtgacagtgtctttgtacctttcacttctactattaatccaaataatttacctctcccatacctaataaaataataaatctaaatcttaagaacgtacattcctaaggtaataaccgtcttgtaagttatgaaatagctggcaatagttttgacgaatgtctttccctatagatgcgcaaggaaccgttgatgcattaagagcatccatatctatataggggtgctccacattacccaaaccgattacccatcctttagcagtgacaagattatagaaatccatctgattatctacaaaccaccctgccgctacttttgtattacaaaacaaagcctcaatgcacactgtacttgctgaacaaataacgagatctgactgcctaaacaaatcagccatttgttcagctgaaaggcctgaacaatatgtaaggcgtctatcttgtgatatagggtggattggtttataggcatcacctacaactgcggttattgatttaacatttttgctctcaagaagattacttgcatagtaaccggttgcatcaaaatcatcacaaccgccaaatgtaatagtaactttttctatactccctatagtatgacaacgttgttcttttacagcttcgataaacggatgacggagcaacgcccaatcaacccccaaacagagtttggtatagggctctacatcaaacaaggattcatccgttaacccatggtttatcacaacatcagccacataatgcttgtcgtgcatatcatccacacacaccagacagcatcccttttctttaatggtacgctggtaatcagtagtaaagaaatagttgtcaagtaccacaatttcgtcaccttgcaaaagggaaaggaactcatcataatgtgattcttcctgtaaggggatgaaaggacataccttctccatctcactcacctgataaggggtaggatggcaagtaaagaaggtacaatcaaaatcgtccttcagcatatcggccaaagccagagtacgaataaagtgaccgtagccgatggcagcacttgcatcggcacggagatagattttctgcattacatcatttatgaagcaactcatacttcatctctgccaatgcccagtcagtctgtgtatcaaggtcctgcacttcaagttcggaaagtaccaacccggctgtattctcaccccaaaaagtccggctctccacaaagggagcagtgcgagagaaatagaactgaccggcatcgtgataaatcggttctaaatcttgggaacgtgcatttttgtattcgggataaaccatactaatttttccatccacgatgtgaaggctgcgctgtataggataggaataagccacacaagtgaaaacggaatctatctccgaattcatttttccgtatgcttcccggagtctttcgggagtgacaaaaggagccgttgagtaaatgcaacaaaccgtttcaaactccctgccttgctctttatacttcctcagtacttcaagaattacatcatcagtaccggcatagtcatttgacatctcggcactccgcataaaaggaactttggcaccatatttacaagctattccggcaatctcctcatcatcggtagaaaccatcacctcctcaaaaagaccgctttgtaaagctgcctctatggaatatgcaatgataggtttacccataaagggcttgatattcttacgcggaatacgtttactgccgccacgtgcaggaatgattgctatatttttcatttctctacaaattctataaccttttcaatcacatactcctgttcctcgtccgtcaacgtgggatacatcggaagactcagacaatgttcgtaatactcttctactataggtaaatcgcctttcctatttccccactgctgatagtaaggcatcagatgaagcggagcataatgaacctgcgcatagacattgttctcgtgcagataattataaaggcccaagcggtcagctacttgaatgatataaaggtgataagcatgatagacatcggcagcattgaacggagtcttgataccatctattccggaaaacgcttcattatagcgtcttacgatttcatggcggcgttcaagacctgctttcgcacgctccagctgagaaatacccaaggcagcctgaaaatcagtcagacggtaattataccctaactcctgcatctcgtaataccagccaccatgatgctcgtgcaataaagcagggtctttcgtaatgccatgcgtacggtaaagacaaagcttgtcatagagctccttgctgttggtggtcaccatgcctccctcacccgtagcgatatgtttcacgggatggaaagagaatacggcacagtcggcaaaacaaccgttaccacaatgttgtttcttgcctttactgtccatgaaatagccgccgggagcatggcaggcatcctcgataatccacaaaccgtactcgtcggcaagctttctgaactcttccagatccaaaggatagcctgcaaaatcaaccggaacaatacctttgtaagtaccgcggggagaagctttaagcatggcttcgagtttacggatatccatgaggtaagtatccttgtcaatatcacagaataccacctcgccgccacaatagcggatgcagttggcactggcagcaaaggtcatgggagtgacaatcaccttgtcacccggctttacattcagtgcggtagctgcaagatgaagccccgaagtagcattgttcaccgctacggcatattgtgcacctacatattcggcaaatttcgtttcaaattccctgattttgggaccttgtgtcaggtaatcgcttttcagggtatcgatgactgcccggatgtcctcatctgtgatatgctgacgaccgtatggaataggcttgcttatcatttcacctcgaaattagggtcaacgtatttcttgatattctcgcgcatagtctctactgtctcccactccgtattgttgtcactgctgtagtggaaaccgtcgggaacgggtactgcattgtgatgtctgatgaactcttcgcgactgtgcttgaaagatacggaaggaagaatgacataatatctgcccaaatcgattgtatcaagagcatcggttacagtaatcatctcctcgtgcagtttctctcccggacggatgcccacttccacctgcggcagattgggtgcaatggcggtagccacgtcctggatatgataggaaggaatcttaggaataaagatttcaccacccaggtgatgtccgatggcatacatgaccaaagcgacaccggcttccagtgaaatgttgaaacgggtcatgcgcatatcggttatgggaagttccttcgccccgttgtcacgcttgttgataaagaaagggattacggaaccgcgggaacccatcacattgccataacggactacggagaacctgatgtccttggaaccgctgatattgttggcggcagtaaacagcttgtcggaagtgagcttggtggcgccataaagattaatgggggcacaagccttgtcagtagaaagggccaccacatgctgtacaccggtggcaagagcagcctttatcacattctgcgcaccgtgtacattggttttgatgcactcttcgggattgtattcagcggtatccacctgcttgatggcggctgcatggataatcacgtccactccttcgcaagcccgcgtcaggcgttcgaggtcacggacatcaccgataaagaaacgcagttgcggatacttatgaccgggatatttctgtttcagctcaaattgcttcagctcatcgcgggagtaaataataattttctttacttgcggataatcacggagaatggtttccacaaacttctttccgaaggaacccgttcctccggtaatcaatacggatttattgttaagcattataatgaaaagttttattcatcgatatattcccacggatagggattgtctgtcacattctgaaactcatcaaccgcttcctgctgttcgggagtaagtgataagaaatcccaggaggcgatgatggaacggccttcgtcggccaaagactcgtcgaacacttcaccgtagcaggcggtaagcaggcggagcttcagtaaggaagcgggaagggcatcgagcacatcccaacaacagtccagcactttctggacatgccgctgcttttcgccatggtccacaaaagaggcgctgtaacccataagaagggcaagacagacatttgcctgctcttcgatggtagtgccttttacacccgaccggtacaaagccatggtaagacggtagacctcaccgttccgccgtgacaagtcatcgctatagacgggactgccgtccatacccaaatacatcagttcgtgcgcagcacgctgaagagtgattgcttcttcggaaagagacataagcaattatagaattaagaattaaaaattaaagttcagccgattacttctataagatcgggatggatagtggccatggcaacagctatgacaccttgtatttcgataaccacgcgacggtcacgtgcacctttcaccttcagaaacacaccctcttgcccctcaaattcaccgccggtaatccggactttggtgcctttggacaagttcaattcatccggttgaaaataaagaagatgatcatcgtaagtgccggatacggcaatgaaacgctgcatctgactgtcggggacaataatcttctgcccactgcgggtatcggtgatatattgcagataagtgacttgagattttacacgctgcacatcggaaggacgggcatggacaaaaagcagattatgaacgaccggaaccagagcacggacttttttccctttttttatacatatcttgtattgcataggaatgaaacagcccaaattttctttcttgagcagatgcatggcatccggttctctgcggtaggtggcacgcatagcataccagatttcgacctctttctctattcccatttttatgcttttgttcagacaagggtgttctcctggggctttgaatctcttgcatacacttgaaattcaattacttgcggacactttatgtagaatacgacaagctttatgcccttcttgtcaacagattttttgcagtcattcattacctaacaggtaaaatgctgtaaacgaatctattgcaagcaaaaagcgttcaatagacgttcgttttttgaacgtcaatatttaagaaaactaaagagggaagattacttaaaaattagtaaaaggaagaagttagagaaatacaatgcaataggcttactgacaaagtattatactcactaaaaagaaatttatagaatatttttattaaacattttgcgagattcaaaaatacacgttatctttgcgttcattaaacgaacgtttaaaaaacaccttttccaaacgaaatattccactgtataacaaataattacattgaaataaaaaatatcgtgtttatagaaatcagattcctacaaacacgatatcaattaaaaaagaaattactattctcagaagttaaagatacccaattccgggaaagtagccccttgcactgcaaaacagattccgaagcaagccgcacttacaatccaaagaataaccagcgtccacttcaaaccggaattcatcggctgccatttgaatatctgactgaagatggcccatacaagactgaccaaaggaattcctaccagcaagattcctgcaatgtacatcacaatggcagacaacggagaagtaggcagtaccacatcagccatcgggaaaaaggaaatgagagccgcaccgccaccaacagccaccgctatcgcagcaaacaacaacgccacaaataccactccaaatacaaacagtaccggactgcagataatggcaaatatcaccagacagattttcaagaaccagccgacaatcatcaccaatgcatctcccaacttctgcaagaaagtacggggtttgtccgacctcatataatcattcaccccattggcaaccttctcaaaaccgtccgtcaccgtctttccgatattctctaccgtaacggcctcgccacgcatactcaacttctcggctgctgtgcgggcttccggtataaccagccaacacacgatatagaccggtatcaatgtccctaccccacaaatcaagatgacaagcagtaacagtcgaagtaaagttacatcccatcccagataggcagccattccactgatgacaccacccagcattttgtcatccggattgcggtatagacgacggcgtgtagtgccataagcggtattgctgttccaagcaccggcaccatagccgcccccggcactcgtgctgccggaatcggcactagcactctctccttctgcctccatatcttccggctttcccatgcgggcaatcacctcttccacgtcggctatcgtgattacttgtgaaccggccgacaatttctcggcaaagagttcggaaatacggcgttcaatatcatctacaatctcgtcggcaccggcttccttgcggaagtgcatcttgagattactcaaataattatccaaaagacggtatgcgtcatcatcaatattgaaaacggttccacctaaatttacagttaatgtctttttcataacacattatttatttacaattttactatttacgatttaccatccggcgaattacggtatattctcttcggctatttcaagaattgctgatgtgattcaccgtctcgttcaactctttccaggatgtttccagttcaccgagaaagacttctcctttttccgtcaaccggtaatatttacggggaggcccttgtgtagactcaatccattcataccccaaaaggtcgtcgttcttcaaacgggtgagcaacggataaagtgtaccttccaccacaatcagtctggcttctttcaacttctgaatgatatccgaagcataagccggctctttgtgaagcagcagcatgatgcaatattcaagcatgcccttgcgcatttgcgactttacattgtttacatccataatggtatttactatttgacaatttactatttggctgcgcaatagagtaatgagtgtccttattaattctattgttgttccttgtatggcacaaatatatgtattataccagtaccttgtattacaaagtactttatattaaacattattaacaagaaaagtagttcacgctactctataacatcagtaacgtgaacagagaggaagagggatatttaccgatggataacaattttatccaatataccggtcagactcgcaattgctactccgtagttggttatggggatgtgctgtgcgcaagcatgggctatacgattgagaacgtacttccggttgaacatgcaagcgccgcaatggataattaaatcatatcgggacaagtctctgggaaagtcatttccagagacaaagtctatctgcaattcctcgccgatgcgctttcgtagcaggcggggaattttgacggtgccgatgtcctcggtcagcggagcatgggtgcaagcttcggctatcagtacacgcgattggggtgtcaggctatgaatagcggcagctccctctacaaaggcattgatgtctcctttgtaaccggcaaaaagaaccgagaaggaagtaagactactttcggcaggcttttgttgatagacgatggggaatacttgtgaatcggtgattatcagcttaggcggacggacaagggcttgcagggaggcttgcagcttgtcggtggtgcagctcatcactaagcactttttatccaacagttcgcggatggtctgcacttgcggaagaatgagacgacctttgggggcttgtatatcctggggcatcaccagcaggacgacatctccttcacttaccaaattgcccgtgatagtctgctcaccaaaattctcgggaagcttttcgaggatagtatcgaaaatgccttgaatgccggtaccctctttggcactgaccacaacgggagcctgcccgcactccttttcaatccgaagaaccacggaagcggtgtcttgacgggaatcggctttattcagtatcagtatcacggggatttcgcgcgcagccagtagctttagccattgctgttccagcgttccgtcagcttcataaagcaagagggcgatgtctgctttctccaccgtctttaaggtacgctccacgcgcataccgcccagttcgccttcgtcgtcatcaaaaccgggggtatcgataaagaggcacgggcccaaaggatatacttccatggctttggtcacggggtcggtagtagtgccgggcgttgcggataccaatgccgtgtcttgcccggtcaaggcattgacaaggctggactttccgctgttccgtcgtccaaagacggcaatgtgcaggcggttggaacgaggtgtattattcataaatccgaaatctaaaatctaaagtctcttttcccctcccctatctcctgaagattacgttcggctatcgcccgtatcttggggttcgggatatgctccatctcctcacgaatcagctgtatgcccttctccttggtttcggaggaggcatagtcctccagatattcttttaatgtcatcagtgcattgggctggcagcagtttgctatctgtccgcgcttaacgagcgacatgaagcggtctccggtacgtccctcgcgatagcaggcggtgcagaagctggggatatgtcccagatcgagcagccagctcaccacttcatccagcgtgcgccgatcgctcacatcgaattgggaggaatcttcctctttggcttccggcacggcatagcctcccacgctggtgcgcgaaccgccgcttatctgcgaaacgcccagttcgagcacccgacggcgtacggcttccgactcacgggtggaaataatcattcccgtataaggcaccgcaatgcgggtaaccgccacaatacggcagaacatctcatccgagatggcatcgggaaaatcctcggtcgaaatatcatctgccggacagatgcgcggcacgctgatggtatgcggacccacgccaaaggtagcttccagatgttcggcatgcatcagcagtcctacaaagtcatagcgataggtattcagaccgaacaatacaccgatacctacatcgtcgatgccaccctccatagcgcggtccatcgcttcggtgtggtaggcataattacttttcggtcccgtgggatgcaaggcttcgtaatgctctttgctgtaagtctcctgaaaaaggatataagtgccgatacctgcctctttcagcaaccgatagttttccactgtagtggcggctatgttgacattcacccggcggatggccccgttcttgtgatggatgctgtagatggtgcggatagactccaagatatagtcgatagggttgtttcgagggtcttctccggcttccagcgccaggcgtttatgccccatgtcctgcaaggcgataacctcgcggcgtatctcctcttgcgagagtttcttgcgggggatggtacggttcttggcatgatacgggcaatagacgcaaccgttcacgcaatagttggaaaggtaaagcggggcaaacatcacaatgcggttgccatagaatttccgtttgatttcacgtgccagatgatagatgcgctgcaccagttccggctcgtcacattccagcagcagggccgcctcccgatgggaaagcccctggcacaaagcagccttgtcaatcaaactttcaatgagcggacggttgttgcggtttgcctgcgcatactccaatgtatccaatatctcctggtgattgatgaattcttctgcttgtcttgactttatgttatacacttcgtaaattgataattggtaattaaaataaagaatgaagatttgaaaattatcaattatcaacggtcaattctccattctcataatctcctctctctcttgatacctcgtagcctatccctttcagttgttcctccaattttagcaaaccttctgccgcttcggcacccgcagaagctttgttatcatagagggagtacttcgcccgctgatgagaaggcgaaagattaggcatcacgacattggcgccagccaatattccccgttcccgtccgtccggagcaagtgtggccagggcagtggtagcaggtatcagtgccgcgggatgcatcaaccggaagatagaaagcaacttcaacgtcaactccatatctcccggcggaaaagaggaaaacggagtatcgtgatgcggaagaaaaggtcccatgcctatcatctccggctgaaaccgttcgatgaagagaatgtcttctaccaaatggtccaccgtctggtaaggactgcccaccatgattccggttcccacttgatagcctatctctttcagccagtccaagcattgcaaccgatgggaaagggacatctccgcaggatgaagccggtgataatgcccttcgttgcaggtttcgtgccgcaacagatagcggttggcacctgccaggaagaaacgttcgtaggcttcccgcgatttctcgcccaaggataaggtaatggcacaatccgggaaggattgccggatagcggcaactgcctccaccatcccctcatccttcaccgccggcacttcgcccccttgcagcacaaaggtacggaagcccaaccgatagccttcatggcaacacgaaagaatctcctcctgcgtcagctcataacgggttatgttccggttctccttccgtatgccgcaatagtagcagttattgcggcaacggttggttatctcaatcagtccgcgaatgaagattttattgccaaagcgggcaagcgcttcttcccgagcaagctcctgcaggtaggctgcaagttctgtgtcccggcaaagaagcatggctttatactcttcggcatccagcctgcggttgctccgcagtttgtcaatcaaatgcttcatataaacggacaaagggctaatacgtctctttcctctttgccaactcctgcgtcagctggcgctttccggcagttatttcattgtgcgaacatggcccggtaatacaaccgccctcgcaagccatcacttcaataaattgccccggagccttgcccgacttggcgtaagcacgcaacgcaccgatagccttcttatccagattagccacttgtacggcattgattttatctgcctcttccttcagataggctttcacggcacccatcacgcctcctgcctgcgcaaaaccatgcgcctcgcgcacggaagtgaaactcatggaatagggctttgcctgctccatctgaatatccagcccggcaagcacggaagccacctcctcgaaagtcatgataaagtccaccgcctcgtcgcgctgcgcctctttgcgcttggcaacgcaaggacctatgaagaccaccttcgcatccggatacttctctttagcaatgcgggcagcataatacattggcgaaccggtgcccgacacgtaaggcttcatggcaggaatatgcttgttcaccaactctatataagacggacaacaggaagtcgtcataaacttctgaccctcctccagcttctcaatcagctcgtgcgcctcgttgctgacggtatccatcgcaccctgagccacctcaatgacatccgtaaaaccgacttgtttcaatgcgccatatacttgttcaatagtcgtcttgaactgccccaggatggacggagccacgatagccaccacctgctcacccttgcggattctgtgcaacacgtcgaacacctgcgatatttcgaaaattgctccgaatggacatgcattgagacactttccgcaatagatacatttgctttcgtcaatatgctctatccccttctcatccttactgatggctttcacgggacaagcttcctcacaaggtacgggaatataaacaatggcatggtagggacaactcttatggcagatgccgcaactgatacatgcatcatggtcaatccatgcctgaccgctctccttgacatgcactgccttcttgggacaattcacctggcaactgcgtgccgtacatccgcggcagaggttcgtaatctcgtagttaatctgcacacatgccgaacaagcttcgtcaatcacacacatgatgttgtctttcggcctgccattttccgctctgtccagtgcacgggcagcgtactccgacaagggggtcagctcatccgtctcgtcctccatatcgagtcccagaagcggcaatgacttgtacttccacaccgcgcgctctttgtgcacacagcagcgtcccgcgtgcttggacctcttcggactcagctcgatgggcagccggtctattttatccacaagttcgttgttattccacagctttaccagttccttcagtaatctgtggcggacaatcataatgttgctcgtaaatgccataatttttaaaatcaaaattagttagttcggtaacggtctgcaaagataacgattgtttcacaaaaaaggcttaactttacaccccaaacagtataaatacaaccgatatgtttaccataagaaaagcaacgacagcagactgcgcactgattcagaaacttgcgcagcaaatattccccgtcacgtataaggatatccttactcccgaacagaccgactacatgatggaatggatgtattcattggacaatatccgcaagcaaatggaagaggaaggccacgtctacttcctggcctacgaagaatgtgaagcggcgggctatgtgtccgtacagcagcaaggagaagatttattccacctgcaaaagatttatgtgctcccctattaccagggtgcacattgcggcagtttcctctttcgagaagccatcaagtacatcaaggaagtacatcccggcccttgtctgatggaattgaatgtaaaccgcaacaacaaggcactgcagttttacgaacatatgggaatgcgaaaactccgtgaaggggatttcccgataggaaacggatattacatgaatgactacatcatgggactggaaatctgagtcccggcattaaaagccctccaaaaactaaaggctgcgcagttcattacgaacattgcgcagcctttagttttatctttcgtttccgattacttcgccaccttttcaagccatttcagcatgaacagcatggtgaacatggaaatgcagcacgctactacaaataccgtccacgtcatccagataggaatactttcgtagaggatagcaccgataacgagcaactgattaccaatggcagtagcaccgagccaaccgccctgcatgataccctgatatttgggaggagccaccttggatacgaatgaaatgcccaacggagaaatgtacaactcggcaacagtcaatatcagataggtaaccatcagcaacagcggagtcaccttcaccggagaggtacccaaagcgataatatccttgtgcatcggcaagttgcttacataagaaccgatagccattataaggaagccagtggcagcaatacccataccgatggcaatcttccgcggagtggaaggctctttacccttggcacgctgtgctgcaaagacagccatgatgaccggagtgagagacacaacgaaaatcgggttcaaagactggaacagctcagctgaaatagccatgccgaacaaattcaaatctgtatattccttggcaaaataagtcagtgtcaatccattctgatggaacgagaaccagaagaaaattaccacaccgaatacggcaaacaatgcatacatgcgctgtcttacctcttgtgcattcatctccactgcagtggcatcgcccgcttttgcagcaaccttcttgctgggatcggggaatttctttctgttgatgacgaaaattaccaaagagagaaccatagccaggatagctacaccgaatgcataatggaaaccagtggtgaacacgttcagatattcattggcaaataccgtcatatccgttacgggtgttccggaaatagtggctttggctgccaatgcgctataagtgtccacagcctcgggagtcagcgttcctgccagatgtccgtggcaaagggcaggcaggtcggcatcataattgtagccgaatgtggacaaccaccagttacgcacgcctactgcggcaaacggggcaaagatggcacctacattgatgaacatatagaataaggagaaaccggaatcgcgcatgctggagtactgaggattgtcgtacatctgccctacgagcgcttgaagatttcccttgaaaagaccatttccgaaagcaatgacaaacaaggctgcacaagtaatcaccagaaacaaggtcttattggcaaccggtgtaggagacgggatggccagcatcaagtaacctaccgccatcaaaacaataccggcaaagatggtacctttgtaattacgggttctgtcggcaataataccacctatcaatgctagaatgtaaatagaaaaataaaatgttgagtagatcaaacctgcctcttttccatccagtccgaacttggcttgcagaaaaagtacaagaatggccatcatggtataaaagccgaaacgctcgcccaaattagcaaaagatgcggcaatcagacctttagggtgtttgttgaacataaaaattagtttttagaattagtaattggattgatttcttgaataattcctgcaaatatataaattctattgaagatttccttataaaattaaaatatctcggcagaaatagaagatttattcattaaaaagaatacaaacctctgcatgcacttcccttaccaaatccttcggatccaacttaagctgcaaaccgcgttgtccggcactgatatagatatacggaaaccgcaggcacgtttcatggatataggtagggaaaggtttcttcatgccgatgggtgaacacccaccccggatatagccagtcagaggtaaaagttccttaaccgggataaggtcacattttttgtttcctgacgcttttgccgccagcttcaaatccacttcgtgctcacccgggatgacacagacaaaataaccggatttatcaccgtgaagaatcagcgtcttgaacacgcaattgatgtcctcacccaaactggcagctacatgcactgcacttaagtcgttctcatccacctcgtagggaatgagctcatacgcaatcttggccttgtcgagaagccttgctgcattcgtcttattgattttcataatattctctatgatgagataattatcacttgatattcaattcttcacgcaggaacttaggcgtatagcctttcttgcttttagcaacctcttccggggttccgcaggaaaggagttctccccctcccttaccgccttctggccccatatcgatgatatagtccgccatcttgatgacatcgagattatgctctatgacgatgacggtattccctttgtctacaagtttgttcaacacgttcatcaaaacgcggatatcttcgaaatgaagtccggtagtaggttcgtcaaggatatacagagtcttgcccgtatcacgtttggaaagttccgtagccaacttcacgcgctggctctcacctccggagagcgtggtggaagactggcccaacttgatataacccaatcccacttcctggataaccttaattttgttcaatatctgaggcacattctcgaaaaactccaccgcacggttgatggtcatatccagcacatcggcaatggattttcccttaaaacgcacttccagcgtctctcggttgtaacgcttgccgtgacatacctcgcaaggcacatacacatccggcaggaaattcatctcaatgcacttgtacccattgccttggcaagcttcgcagcgtccgccactgacgttgaaggaaaagcgtcccgccttatatccacgtatcttcgcttcgggcaagccgacaaacagattgcggatatcggaaaacacaccggtataagtggcaggattggaacgcggcgttcgtcccaaaggagactggtccacattcaccaccttgtctatatattccagcccttcaatactgtcatagtccaaaggatcctgcagtgaacgatagaacttctgcgaaagaataggctgcaacgtctcgttgataagcgtggacttgccactgccggaaacaccggtaacgcaaatcagcttgcccagcgggaactccacatccacattcttcagattattacccttggcgccacgcagccacagactgtgtccattgccctcgcgacgcttggcaggcacctcaatggcacgctcaccattcaagtattgggaagtcagcgtatgcgtccggagcatttcacggggagtaccggcaaagacaacatcccctcccagcctaccagctttcggccccatatcaatgacataatcggcggcaagcatcatatccttgtcatgctccaccacaatgacggagttgccaatgtcacgcagttccttcaaagagtgtatcaagcgctggttgtcgcgttggtgcaggccgatactcggctcatccaatatatacagcacattcaccagctgtgaacctatctgcgtagccaggcggatacgctggctttcaccaccggaaaggctgacggaactacggttcagcgaaagataatccagacctacatcaagcagaaatttgagccgtgtacggatttccttcaggatttcaccggcaatctgctgttgtttgctactaagatacgggtctacgtttaccagccagtcatacagttcattgatgtccatcgtagacaattcgtagatgttcttgtcgtgaatgcggaatgaaagcgcttccttattcaacttggcgccatgacactccggacaaacggcagtcttggcaaactggtccgcccacttctgtgccgtggcagaagcatccttctcctgcaacatctggatatactttacaaccccctcaaacgtcacaaaataatcggaagaggtgcctatcagtgaactctttatcttgatacgctcgtccgagccgtagagaatctcgtcgatggcatcctccggtaagtctttgaccggtgttttcagcgttgcttcatatttctccagcaaggcagtaatctgccagaagatcatgctgttcttggctttccccaacggtgcgatggcacctccggcaatggagagctcacggtcgggaatcaccttgtcaatatcaatctggctgaccacccccaatcccttacacttagggcatgcaccttgcggcgaattgaaggaaaagttgtgcggcgccggttcccgataggacaaccccgtcacgggacacatcagccgtttgctgtaatgacgcacgctatccgtctgcgcatcgagtatcatcagcaatccgtcaccttgacgcatggcagtggccacgctgttcttcaggcgtgtgtcatccttgtccgtcaccaccagcttgtctatcaccacctccacatcatggttcttatagcggtccagcttcatgcctggcaaggcttcgcacacctcaccatccacacgtacgtagagatagcctttcttacgcacctgctcgaagagctccttgtaatgccccttacggctgcgcaccagcggagcaaggatataaatgcgttttcctttgtaatccttcaggataagatcaagtatctgttcctcggtatacttcaccatcttctcgccggagagataagaataagcctctcccgcacgggcatacaacaaacgaaggtaatcataaacctctgtcgttgtacccaccgtggaacgtggattcttattcgtggttttctgctcgatggagataaccggactcagtcccgttatcttatccacgtccggacgttccaaatttcccaggaagttacgggcataggctgaaaaggtctcgatatagcggcgctgcccttcggcaaaaatagtatcgaatgccaaagaggacttgccgcttccgctcaggcctgtaatcacagtcaggctgttacggggaatctcggcatcgatattcttgaggttgtgcacgcgcgcaccatatacattgatatattctgtttcttcttgcatgttgatttatcctatcgttttaactgcaaaaataactgtttccccccgaatatcagccgaaaagcgctatttttcagttttgaaatgcacaatattatttcttaacgcaatcctttggtttgaatgccacaatattcgtacctttgcagctactttgggaaattgtaaacataaaccaacgattactgaatgaaaacgattaaccgcattatctgctccctgctgcttgccagtgcatgcagtatcggtgcaatagcacaagagaatcaatcttattttctgcatactatcgaaaaaggacaaagtctctactccatcgccagcatgtacggcgtcagccagtcggacatcatcaaactgaaccccggcagtgacgagaaaatattcatcggacgcacattgcgtattccacgcagcgctgccaacatacaaaaagaaacataccataccatcgaaaccggtgagaccctttaccgactgaccgtgaaatacaatgtatctgccaaagccatctgtgacgccaacccgggactgagcgccgagaatttccgtatcggacaagtaatccgtatcccttccacaaccgagccccaaaccatggtcccggttgagacacaaagcagcactgtggttgccaacaacaatattctcggccccgtagagtcacgatgccgtgacatgcataaagtgaagcggaaagaaaccgtattcagcatcagccgtgaatacggcatcagcgaagccgaactgatagccgccaacccggaattaaaaggcgaaaacaaaataaagaagggaaccttcctctgcattccctatcccaaagcacagacggagcaaaatatccagtcgcaggcaatacctaccgacagcgagctgttccgtgaaaaccggaaaaagacagaacgcttcagcaccatcaaggctgccgtcatccttcccttcctggacggggtatcaaagagcgagtcttcccgtatggtggaatactacgaaggcctgctgatggccgtagacagcttgaaacgtactggcacttccattgacttgtacacttacaattctggtcccgaaagtgcctcgctgaactccatcctgggcaaaagcgagatgaaagacatggacatcatcttcgggcctctgtaccaacagcacatcaaacctctggccgagtttgccaagaaacaagacacacgcctggtgataccattcacatcgaaagacaacacggtattccagaatccggcggtctatcagataaataccccccaatcctatctgtactccgaggtgtacgaccactttgtgcgccagttccccaatgccaacgtcatcttcattgaagccagccagggcaccaaggacaaggcagaattcatcaagggactgaaagatgaactgcgcaaccgttccatcccgatgaagagcttgaaagaggatgtcaccgtagaatccctgaaaacagtattacgcacggaccgtgagaatatctttatccccacatccggcagtaacctgacattgattaagatacttccccaattgaccttattggtgcgcgaacaacccgaaagccgtatccatctgttcggctatccggaatggcagacctacaccaaagaccacttggaagccttctttgaactggacacctatttctattcctctttctataccaacaacctgctgcctgccgccatcaactttaccaaaaactaccgcagatggtatggcaaggagatggacgagcgctatcccaaattcggaatgctgggcttcgataccggttatttcttcctgaaaggacttgcgcgctatggctcttctttcgagaagaacatgcagggactggatttgattcccatccagaccggcttcaagttccaacgggtaaacaactggggaggcttcatcaacaagaaggtgttcttcgtgcacttcaccaagaactttgagctggtgaagttggactttgattagggattaaggattaataatctgataatccactatataactattaacttgtagcttgtaacttataacttataacatgaacctgagaacaatcatcatattcgccctgctggtgtgtgcatgtatattgcccctgcatgcgcaggtgggcgagcaacgccacaacttcgctgtgggcgtcaatggaggcatcaatctgaatagcgtaagcttctctccctctgtcaagcagaagaatctgatgggtatcaacggcggtgtaacagcccgatacatttccgaaaaatacttcagtatgatttgcggtgcacaaatcgagctgaacttctcacaacacggttgggacgagtattacgaggactatcccacactgagctacacccgcaccatgaactatgtggaaataccgttcctggcacatctggcattcggcaaggaccgcggtttgcaattcttcatccatgccggtccgcagataggtttcctgcttggcgacagcgaaaaaatagacggcgactgggacggcactgtagcagaatcctacaccaacatcaccgtggaacagcacggcaaggccatagacaacaaattcgactacggcattgcaggcggagcaggcatagagctgcgcaccaaggcaggcaatttcatcgtagaaggaagatactactatgctttatccgatttctatggcagcaccaagaaagactttttctcacgctccgcacacggagtcattacggccaagataacttatctcttcgacttgaagaagtaatgcttataggagacacccgtttccacacgtaggaacgacaatttcctctaatgggaacagtataatggaacggcttaacctcaagcggaaacgataaaaaaggcagaccacgtattccgaatgaaatacgtggtctgccttttgttattatcaagtagataaaccttcttatcttcttaaacggtctgccgccttcaccatcacctcatctttgtagatggcacggaaggccagatagttaaggatgatggctaccaccggaaggcaaagcgcccatcctaactggaaagtcattgcatccaaatcacccttcaaaataaacataaatacacagaaggctatgtagtagcctatcagcagaatgctgctgaaaatcgtcatgcgtatttgcaacatacggttacggaaaaggaatatcgtacagaaggcaacaagtgcactgagcaacaatatcccgaacaagccccaagtagactgaaatcctccgtcggccaaagccactcccagaggtttgaaaacatgcgccgtcactccgtccgctccgatgaactgtcctacaggcatgcaaattgccacaaccaacaggatagttaccaacaacaaataaacagattgaatacgttgtatcattactgtaatttttctttttccttagccgggttacgatagtaaatcttaccctccacatactcttgtgttgcaatcaatgtcggcttcggcagtttttcgtaatagcgggaaatctcaatctgttcccggttttcgaacacttcttccaaattatcattgtaagaggcaaactcagcaagctttttggaaaggtcattcttgatttccacactaatctggttggcacgttttccgataatcgctacgctttcgtatacattaccggtatcctcacacaactccatcatatcacgggtcaccgtagtagtaggagcatttgtctttctgtaatccataaatttatctattgtattattatattattgctcttcacttccttctcccagcattttctgtgcttccttaaagattcggtcgacttccttcatatacttactttcggggaactcatttttaaaggcataacattcatccacagcttcgcggtaacgttctgcccttttgtcttccacactgtatacagccaactcatacttggcacgcaagataagaatggataaatcttcacgcaggttggtatagggataatccttcaaagcattctgcgcagtgataacgcaagcctgatagttgttacccagataattacccatattataataaagttttgcagacagatactccttcatcaccagcttgtcctgcaaggcaaatatcatgttctgcgcctcctctttcttggaactttgcgggaagtattccataaacatctgcaactgctggatggcgctatacgtgccggattggtccaaacgcggctccggagtatccagatacaaagctttaccggcgtggaaacgtgccagttctgtgaatgtaccgcggggataaacgttgtagtattgaatgaaagtctgcgcagcagtctgataatccttctggttatagtaactcatgcccagcatatagagggattcctctgccttatcagtacctttgagaatagcaatcaattcgttgagcaaagtggcagcacggttatactgaccttttgcgaagtaattttttgccgcttcgtacttgtattcgtaatctgtgcttttcagcaatttgttgtattctccacacgaggagagcagcaatgctgcaagcagagttattaggatgttcttcttcattacttttgttcaaataatgcgcaaagataggggttcgcatcgaataaagcaacgatacgagccttaatttttcaaaaaccagacgaacgggcaggaaataaggattaatggttaggaattagggattagcggttagtgccatgcggagtaatagcgcaaccaccaaccactaatcgctaatcactatttttacattttacagcttatacaaatcgcttgccgccagcaaatcaacctttttttctgtcaatacacggatgcagttatccatgtcgttaggacggatgatgacattggccgtttcaccgttggcaaaggaatacatgtactcgatgaagacaccttcatcggagaggaagcggagcactttcgccaatgagccgggaatattgggacaactgatgcctaccacatccgttacattcacagcgaagtgattatctttcaaagctttatatgctttatccggttcagaaacaataccacgaaggataccgaaatcggcattctctgcaatacatagagcagaaaggttgacaccttcttttgcaagaacttcagtcacctctgtgaggcggccggacttgttctccagaaaaatggaaagttgttttgctaccataggttcatttactatttgacaatttacaatttacaatttggcaattacaatttgcggttgtcgatgacgcgcttggctttgcctacgctgcgctcaatactgcgtggttctaccagacggacatctacaccgagaccgagtacgctctgcaggcgggctacgagcttcttcttcaaagccagcatcttgttgatttcgtcggaatagtattcgggacgaacttcaacctgcaactccatggtatcggtattgttcttgcgatctaccagtaagaggtagtgaggttcgaactccggcatttcgagaatgacagactcgatctgggtggggaatacattgacaccacgaataatcagcatgtcatcgctacgtcccaaaatgcggtccatacggaccagtgtgcgtccacaggagcacttatcgtagtgcagggcggtgaggtccttggtacggtagcgcaacagcggcatcccctctttggtaaggtgagtgaacaccaattcgccggtttctccaggggcaaccggttcgagggtcttcgggtctacaatctcggggaagtaatggtcttcgttgaggtgagtgccgtgctggcactcgcactcgtaacctacaccgggaccggcaatctcgctaagtccataaatatcaaaagccttgattcccagctttgtttcaatatcccgacgcatattttcggtccatggctcggcgccaaaggctcctattttcaacttgaaatcttctcggggaaggccggagtccttgatggcatctgccagatagagggcgtatgagggtgtgcagcaaagcacggtagaaccgaaatcatgcatcagtgtaatctgcttctctgtattaccgctggacatcgggatgacagaagctccgatattctcggcaccggcatgcgcacccagtccgccggtgaaaagtccgtaaccgtaggacacctggaaaatatccgaactaccggcaccataggcggtaaaggcccgtgaaaggcattcggaccatactgaaaggtctttccgggtatagcctactacagtgggctttccagtagtgccggaagaggcatgaatacgcacaatctggctcataggtacggcacagaggccaaagggataattgtcccgcaagtcatacttggtggtaaaaggcagttttacaatatcatctatactgtttatgtcatcgggagtaattcccagttcctgcattttcttacggtaaaaaggagtgtcatgatacacacgttccacagtctttttgagacgaatgctctggattttacgaaggctttcgcggtccatgcattcgatgctttcattccaaatcatgtttttcgttgtattacaattattaatggttattatcaatatagctgcaaagtaaacaaaaaaattttgtttatctcaaagattttaccgaatattgccgcttctaagaagagaaaatgaacaaattcgaactgacatccgcttaccagcccaccggtgaccaaccggaggccatcgcacagctgaccgaaggcgtgcgcgaggggcttcccgcacagacattacttggtgtcaccgggtccggaaagacattcaccatagccaacgtcattgccaacatcaacaaaccaacgctgatattgagccacaacaagacgctggccgcccagttgtacagcgagttcaaaggattcttcccgaacaatgctgtggaatactatgtgtcctactacgactattaccagcccgaagcctatctgccctcttcggacacttatatagaaaaagaccttgccatcaacgacgagatagacaagttgcgccttgccgccacctcggccctgctttcgggcagaaaagacgtagtggtggtatcctccgtttcgtgcatctacggcatggggaacccggcagacttctataacaacgtcatcgaagtgcagcaaggcaagaatttcagtcgcaatgtcttcctgcgacgcttggtggacagtctttatgtacgcaacgacattgacctgaaccgtggcaacttccgcgtgaaaggcgatacggtggacatttatctggcttacgccgacaacctgctgcgcgtcaccttttggggagacgaggtggatagcattgaagaggtagaccctctgagcggcgtaactgttgccaagttcgacgcttataagatttatcccgccaacctcttcatgaccaccaaagaagccacattacgtgccatccacgaaatagaggacgaccttcacaagcaggtacaatggtttgaaaacgaaggccgcccattcgaagccaaacgcttgcaggaacgggtgacctacgatatggaaatgatacgcgaattggggcattgctccggcattgagaattattcgcgctactttgacggacgtgctgccggtacccgcccctactgcctgctggacttcttccccgaagatttcctgatagtcattgacgaaagccatgtcagcgttccgcagatacgtgccatgtatggaggtgaccgtgcccgcaagataaacctggtggagtacgggttccgcttgccggctgccatggataaccgcccgctgaagttcgatgaattcgaggagatggccaagcaagtgatttatgtcagcgccacaccggcagattacgagctgatgaaatccgaaggcatcgtagtagagcaggtcatccgcccgaccggactcttggaccctatcatccaggtacgtcccagccacaaccagatagatgacctaatggaagagatacagctgcgcatcgagaagaacgagcgtaccctcgtcaccaccctcaccaaacgaatggcggaagaactgacggaatatctgctgaacaacaacgtgaagtgtaattacatccacagcgacgtagatactttggagcgtgtaaagattatgggtgacttgcgcgaaggcgtttacgatgtacttgtcggcgtcaatctgctgcgtgaaggcctcgacctgcccgaagtctctctcgttgccatcctcgatgcagacaaggaaggtttcctccgttcccatcgctcactgacacagactgccgggcgtgccgcccgtaacgtgaacggcatggtcatcatgtatgccgacaagataacggacagcatgcaactgaccatcgacgaaaccaaccgccgtcgcgagaaacagttgaagtacaacgaagagcacggcatcacgccccagcaaatcaagaaagcgaagaacctcaatgtgtttgccaccaacgaggctgccggcgaagccgtcctcagcggcgagaagttcacttccagtgccccccgtccctatgtggaacaagaaagtacatctacgctggctgccgacccgatagtgcagtacatgagccgcaagcaactggaaaagagtatcgaacgtaccaagaagcttatgcaggaagccgccaagaagctcgactttatcgaagccgcccagtaccgtgacgaagtactgaaaatggaagaattgctgaaagaaaaagacgagtaaggaatttcacctcttttcctcaaactatactcctctccttttgttactctatgaaacagagtattaatcataaaaacaaaagcgagatgaataaaccaataaagacaatagctgttgcactggctgccatagccgccatgagtgtacaacaaacagaagcgtgtacccgcgccacctacatcggtcctgacaatacagtcattacgggacgtacgatggactggaaagaagaccttatgagtaacatctatgtattcccacgaggcatgcagagggcaggttacaacaaaggaaatacggtgaactggacttccaggtacggcagtgtcattgccaccggttatgacataggaacctgcgacggtatgaacgagaaaggtctggttgccagcctgctcttccttccagagtccgtttaccatcgaccgggagacaaccgcccgattatgggcatcagtatctggacgcaatacgtactcgacaattttgcaaccgtacgcgaagctgtagatgaactgaaaaaagaatccttccgcattgatgcaccggacctgcccaacggtgccgcttccaccctgcatctagccatcacagatgaaaccggaaacacggctgtcttggaatacatagacggaaaccttgagatacatgaaggaaagcaatatcaagtaatgaccaactctcccaaatatgaactccagctgggtatcaacgactattggaaagaggtaggcggactgaatatgttaccgggaaccaaccgctccagcgaccgctttgtacgcgcatcattctacatcaatgccattccgcaaacagcagatgcaaagattgccgtacccagtgtattgagcgtaatgcgcaatgtttctgtaccgttcggtatcaccacaccggacaagcctcatatctcctccacccgttggcgttctgtatccgaccagaaaaacaaagtatattattttgaatctaccatgactcccaacttgttctggctcgacctgaataaaattgatttcagtccgaatgcaagcatcaagaagctttcgctgacgaacggagaaatctatgcaggagatgccgtaaaagatttgaaagacagcaagggatttgtattcctattccagacaccggtaatgtagtatagaccatacgtatagcctcttgataacggatgcttccccacttatttctattaagagaaagcagggaagcattcattttttcattatttttatgtacgtttgcagatatatactcaatgcagcaacttacatggaattattagtatacaaagcctccgccggctccggcaagacctttacgctggctgtggaatacatcaagcatttgataatcaatccacgcgcctaccggcagatacttgccgtaaccttcactaacaaggccacggcagagatgaaggagcgcatactgacacagctttacggcatctggaagggagaacccgcatcgaaagcgtatttggaaaggattaaggatgaagggttaaggataaaagatgaaaaggcgggaaacggaaacaatcggctgttgacggacgaagacatccgccaacgggccggcatggcactgcaatacatgctgcacgactacagccgtttccgagtggaaaccatcgactccttcttccaatccgtgatgcgcaaccttgcccgcgaactggaactgagtcctaacctaagcatagagctgaacaacagtgaagtgctgagtgatgccgtagacagcctcatcgaaaaacttacccccacttctcccgtgctggcgtggctactggactacatcgacgagcgtatccgcgacgacaaacgctggaacgtatcgaacgaggtgaaaagtttcggacgaaatatcttcgatgaaagctacatagaacgcggtgaaaaactacggcaatgcctgcgtactccgaatacgctgaaactctaccgggatgtgctgcgcgatatggaaaccgaggctctggaacagatgaaaagcttctacgaccagtttgagggcgaactggaagggcatgcccttactcccgaagacttgaaaggaggtgcccgaggtatcggcagttacttccgcaagctgcgcgatggcagactttctgacaaggatgtgctgaacgccaccctgcaaaacagcctgacagatgcaaaaaactgggcaacgaaaacatcctcacgaaaggacgacatcatccgtctggcagaaaccagtctgatgcctctactgcaggaagccgaaagaatgcgtccgcaacgcaaccgtaccctaaacagttgccgcctctcgctccagcacctcaacaaactgcaacttctcaatcatatcgacgaagaggtacgcacgctaaaccgggagcacaaccgctttctgctctcggataccaacgccctactgcacaaactggtgcgcgagggtgactcttcgttcgtcttcgagaaaatcggcgccaacatacgcaacgtcatgattgacgagttccaggacaccagccgcatgcaatgggacaacttccgcctgctgctgctcgaaggactttcgcaaggagccgacagtctgattgtgggagatgtgaagcagtccatctaccgctggcggaacggggactggggaatactgaatagtttaggcaatgaagaattgaaaatggagaatagagaatcaagttctccattaaacaacttccccgtccgtgtggaaaccctaaaaacaaaccgacgtagcgaaaccaacattatccgtttcaacaaccaagtatttaccgctgccatagactacctcaatgcgctacacctgaacgaactgaaagaggattgcctacccctgaaacgcgcttatgccgacgtagtgcaggaatcgcccaagaacacggagtacggctacgtaaaagctgccttccttgaaccggacgatgaacacaactatacagagcagacccttctcgccttaggagaagaagtacagcggctgctggaagagggcgtaacactgaatgacatcactatccttgtccgcaagaacaagaatatcccaccgatagccgactatttcgacaaagagctgcatctctctgtcgtgtccgacgaagctttccgtctggatgcctcccttgccatctgcatgctgatggatgccctgcgctgcctgtcgaatccggagaacaagattgcggaggctgcactgatggagaattacaaattacaaatgacaaatgacgagcaaccggaattcacaacagccactccccttcccgaagcctttacctcccgacgggaaacgctgcgcctgatgcctttgtatgagttactggaagaactgttcagcatcttcaccatgagctgcattgaaaagcaggatgcctacctcttctcctttttcgatgctgtgacggagtatctgcaaagcaattcttccgagctggacagcttcatccgctactgggacgaaaccctttgcagcaagaccatccccagcggtgagatggacggtatacgtatcctctccatccacaagtccaaaggactggaattccataccgtactgattcccttctgcgactggaagctggagaacgaaaccaacaaccagctggtgtggtgcatcccaccggaagagccctataatgccatcagcttagtgccggtgaactattccaccaccatggcggaatccatataccggcaggactatctgcacgaacggcttcagctatgggtggacaatctgaatctgctgtacgtggcctttacccgtgccggcaagaacctcatcctctggagccggaaggaacagaagggaaccatgtccgaactccttgccaacaccttgccccgcatagccaaagacggagcaggcagttgggacgaagaagctgccatatacgagaacggcaagatttgtctctcctccatccccgtctcacagcatgacgcagacaaccctactgatgacgaagccaaacctctatgctacgaacagaaacctctatactgcgaacgtaaacctgaggtttatgaacagcaaccggtcaacagactttcgcaaaagccggtcaaactgcccgtccacatggagagtatgctccacgacatcgagttccggcaatccaaccgttcggcagacttcatagcaggagtggacgaagcagaatccagccagcgtttcatcaaccggggacgtttgctgcataccttattctctgctatcgaaaccgaagaagatattgacaatgccatcagccagctcgtctttgaaggagtaattggacgaagtgagacggaagaagaaatacgcgacctcaccgaacgcgccttctccctgccccaagtcaaggactggtattcggggacgtggcggctgttcaatgaatgcgacatcatctggcaggaaaacggcgaactgcggacacgccgcccggaccgtgtgatgatgcgtggtgaagaaatcgtagtggtagacttcaagttcggaaagccgaataagaagtacaacaagcaagtacagagatacatgcaactgctggtccgcatggggtatgccgcagaaaatatacggggctacttgtggtatgtagaggagaacaacatagaaccggtataaactcactctccatccactatcaactatcaattatcaactgaattatgaaaacatttctccaactggtcgcccacgacctttacgccaaaataggaaacgacctctcgcgcaccgccatcgttttccccaacaaacgtgccagtctgttcttcaacgaatacctggcagccgaaacggaccgccccttgtggtcgcccgcctacgtcagcatcagcgaactattccggcaactctcgccactaaagtccggtgaccccatccgcctggtatgcgaactgtataaggtgttccgcgaagagacccacagtgaagagactctggatgacttctacttctggggagaactgctcatcagcgacttcgacgacgtggacaaaaacctcgtagatgccgacaagctcttcagcaatctgcaggaactgaagaacatcatggacggctacgacttccttgaccaagagcaggaagaagccatccgccaattcttccaaaatttctccatagaaaagcgcacggagctgaaagcaaaattcatctccctctgggataagttgggcgacatctaccgccactaccgccgaaacctcacggaacttggcatcgcctacgaaggcatgatgtaccgcaatgtcatggagcaactcaacaccgaccgactacgctacgaccgctatgtatttgtcggcttcaacgtgctgaatagagtagaaacccgtttctttcagctcttgcagaatgccggaaaagcgatgttctattgggactatgacgtattctacacccgcctcccacgcgaacaaaaaccaccctatacccacgaagcaggcgaattcatcctccgcaacctaaagctgttccccaaccagctccccgaaaaatcctttgatgtactgcggaaacccaagaatgtacgctttatctccgcttctacggaaaatgcacaagcccgttacttgcctcaatggattagggagaacgaaaaacagagaaatgaagaatcttcattaaaggatactgccgtcgtcctctgcaacgaatccctactgcttcccgtcctccactccattccggcagaggtaaagaacgtcaacatcacaatgggattcccccttgcccaaactccggtatacagcttcatcaacgcccttgtagaactacagactaccggctaccacacaggtaccggacgatatacttacgagaccgtactcaccctgctgaaacatccttatacccggcagctttcctcccatgccgaagtactggaaagacggcttacgcaggacaatcgcttctatcctcttccctcggagctgaagcaggacgcattccttgaacaagtctttacaccacagaacggcatcgccgccctatgcagctacctcaccgaactgcttcgcgaagtagccgtcctctaccgccaggaaaaagacgtggaagacatcttcaaccagctgtaccgtgagtctctgttcaaaagttacactctcgtcaatcgcctgctcaatctgatagagaccggggaactgagtagcctgcgcacagacacgctgaagcgactgctgaaccggctgcttacctctgccaacatccccttccacggagagcccgccatcggcatgcaagtaatgggtgtgctggaaacgcgtaacctcgacttccgcaatctcatcatgctctccctcaacgaagggcaattgcccaaagccggaggcgagtcctccttcatcccctacaacctaaggaaagccttcggcatgaccaccatagagcacaaaaatgccgtctatgcctactacttctaccgcctcatccagcgggcagaaaacgtcaccttattatataacacctcttcggacggactgaaccgcggggaaatgtcccgcttcatgctgcaattcctggtagaatcgccacacaacatctcccttgagtaccttgaagccggacaatccccccagcaagcccgggaaattgagattcacaagacaccggagatgttgcaacagatgttcgatgcctacgacatccaccgacgtccccaagcgttcttctccccctctgccctcaatgcctatctggactgccggctgaaattctactaccgatacgtagctggcctgaaagctcccgatgaagtaagcgccgagatagactccgccctcttcggcaccatcttccaccgttctgccgaactggtgtacaacgaactgatagccaacggacgggagatacgtaaagatgacctggaacaattactgaaagacgatgttcgcctgcaagcctatgtggacaatgctttcaaagaaaagttcttccatgtgccccttacggagcaaccggagtataacggtacgcagctcatccattccaaagtcatcgcctcttacctgcgccagctcctgcgcaatgacctgcaatatgccccgttccgtatggagggcatggaacaggacgtcagagaaacgatggaaatagatactccgcaaggaaagcttgccttacagataggcggtaccatcgaccgcctggacagcaaaggagacacgctacgtattgtggactacaagacaggcggtactcccaagactccagaaaatatagaacaactgtttactcccgccgacaaccgtcccaactatattttccagacgtttttgtacgccgccatcctctgccgcaagcaatcgctgaaggtagccccttccctgctctacatccaccgggcagcttccgaaagctactccccgatcatcgaaatgggagcgccacgacaacccaaggtaccggtcaacaacttcgctttcttcgaagacgagttccgcaaacggctgcacggactcctgcaggagatattcagccaagaagaaacattcagccaaacagaggatacccggaaatgtgaatattgcgatttccgcagtctgtgtaagagataaaaaaacagaccatccgttcataagaaacagacggtctatttgagtctgacggatggtctgttttacttcaacggaccatccgttctattttcttcgttatcattacttcaccggaatagagaagctgaatatggagccttcgccctccttggaagtaaaccacagtttaccgccattcttcacgacaaaatccttgcacagcaacaagcccagtcccgagccttcttcgttgttcgtaccgaacgtgctgaaatgcgtatcagcatgcaacaatttcttctgcccttcctcgctgatgccacagccatgatcttgaacactaacaactgccataccattcacttcctccatcttcaccaatatttcggaattctccttgctgaacttgatggcattgctcaacaagttgcggactaccgtcttcagcatgtcaatatcagcgttaaccatcattctctccggtttcatctcgcggattcttatctttttcagacttgccaccatactaaaaatctcaatgacaccgtctgtcacttcgacgagatccacatcctgataaaccacattcaacttaccgatttgactctttgtccatttcagcaagttatccagcaatgagaacacatcctccgttgtctgattagccatcgtcagaagctcgtacatttcagcacctattttctcaaatggcaagttcaatatcagcatattcagcaccatcttgatggatcccatcggagaacgcaggtcatgggcaatcaccgaatagagcttgtcacgcccggcaatggtacgttgcagttcttccgtcttactcaaaatcagccgcttggcagctaccaaagatatttggtgggtaacacggataatcagttcctccttattgaaaggtttagagatgaagtcattcgctcctacctgaaagcctttcacaatatctgccgtactattcagtgcggtcagaaagatgatcggaatttcagcagtctgcggatttgactttaaatgttgggctacttcaaaaccactcatgtccggcatcattacatcaagcaaaaccaagtcaggattttccttttccacctgctccaatgcctgccgcccgttactcgcagtagcaattgcgaatttctcgtttgtcaaaagcactttcaacaataaaacatttgacatcacatcgtcaacgatgaggatcttgtattcggaaggatttatttccatgttcatctttctatattgtttttcccgttatcaaaatcactatttagttaggaacgatattccttaaaatactctattatatactgtaaaccctcttccaactctatagtcggttcccagcccaacttttcctttgccagagtgatgtccggctgacgctgtttaggatcatcatgaggcaatggtttgaaaatcagtttcgatttggaattcgtcaacctgatgaccttttccgccagttccaatatggagaattcattcggatttcccaagtttaccggaccgataaaatcgtcctccgtattcatcatccgtaccataccttctatacagtcatctacatactggaaactccgtgtctgattgcccgaaccgtatatcgtaatatcctggttctgcaatgcctgaaccacgaaattggaaaccacccgtccgtcattcggcagcatccgaggaccgtacgtattgaatatacggataatcttgatccgcactccattctggcggtgatagtccataaacaatgtctcggcacaacgcttcccttcatcataacaagaacggaggccgattggatttacatttccccaataactttccacttggggatgaataacggggtcaccgtacacttcgctggtagaggcctgcaatatcttggcattcgtctttttggccagttccagcatattgatggcgcccaatacagaagtcttgatagttttaatggcgtcatattggtagtggatgggagaagcgggacaagcaagattatagatttcgtccacatctgcatcataaggggtttccacatcatgcagtacaaactcaaagcggggattgctcttcagatgagtgatatttccttccgaaccggtgaaaagattatccagacaaatcacctgatgcccatcgtttatcaatcgggtacaaaggtgagaacctataaaaccagcaccaccactaaccaaaattttcttcatgtaatgttttttatagtgccttaaagcacataagacctattctgtttgttttgatgctgacaaatgtaggcgatttgactaaattatgcaagtttgcaacgaaatatttcacttattaatgaatataaagaggcagattaaaaaatccacccctgaaacattcatttatttatccaacatatactcttctttcttatccggaatgctgaagtccttgttcgcaaataagtctgccaaacccgaaatttgctttaaacgcaatacttcgtcgcgatccattccgatattcttcattatccattcatccgacatgccggctctgtccaattccgcaacaatatggcacatcaactcgatgttgtgcgtgccacgggcacgattgtgacggatagtggatgccatacggttggaaagttccttgtcaatcactaccacgggaagcaacccgttttcgcgctgataaatcctcttggatgtcttcaacacctgataacggtggtagccgtccaccaggatgtaattatccgcttcctcatcatagtaacagacacaaggcatggtgaaaccatcttcccaaatggaaagctccaaaagcttcatttcgggcggtgccactacattcggattgtaatcgtttgcttgtatcttctctattggaattgcctttacattatataccggacttttatctacgctcataacatcatatttttgaattgttccattatcttgtctcttttgtatgcctcttccttgttcaaggcaaaccccatgtacttgcaggcatggtcgttcttcaggatgcatatgcacatccgcttataagtggggatttcccggaattccgcgatgtcaatatcatccagatagtccatgcgcaccggtttcttgttcgtcttgtaattcgtggtatttatcacttcgatggacactcctgcatccctcagcttctggatggtctcgtcagccagacaccccccctttgtacgccaaaattcaatgctaacggtaagctttttcaagtagttcctccgggtctcttccggcaaggtggaaagcaggaactgcataaagcccttccacgtatacccttcgggcagtcggaccgtttgccaccccatagcacgcgtccctccataaataccggtaaagttcaccccgttgacccgccctatcattcttccccaagtattcgggtcgatgacgcgatacagcttcaagctctcttgtgcctcacagagaaaagggcttgccacacgctggcgttcgatattgaccccggctttataatataggtcatacaaatggttatagtcaaagccgaatttaccattggctgtccagatatccgtcgtcttccaatcataaatgggataagcattgaaaatgtcattgcctatcttcgaggtccagcggtaattgtggtacatctgatacttccggttcagatgaatgctgcgccagcggttaaaactctcttgcgtacggatgcctatgagaaagcaggcacgcactccgtccttcttctcatgcagccatttggcaaagtgcatctggaactcataatcccacatttcgggagtgtagaaaggaaacgtctctttagtgaggcagcctttcggcattttcctcacccaaatgtcctccaaatcctcctgccacggacgccagtagctctggtacatcgacgtacaagtcgttacacggaaaggcacgcaaacacggtacacctccaatatatccttattcgcctccaatacccggtccacataatcaatggtcatgctgtactgtatttcatagtccatatggaatacacacagtttacggttcaaccggttccggcggatatagtctatgcataaattcagcaacactccactatctttccctcccgaaaaagagacgcatatcgtgtcaaactccctaaaaatcacatcaagacgttcttgtgccagttcatacacatttttgggtgcagccataattatttgtttttcttcattttcacataacgggtccataccttgtcttccaaaaagcccagctcgctgaagacatccctatcttcgacaaagctaacagccgtcaggctactctccttgccctgcttctcaagtaccttttccagaagcaatttcagagtgtcaacattcctttccttaatataatagttgttgatgacacattcatacttcttgtgctccactggcacaaaacctacaacatgtttattatccaaagcaacaaaccactcgtactcttccgctgtcctgaaaggataattgtagttctgtttcagtacttccggactcataaccaaaggggctacaagctcatacagcttcttatccgtaccatgtaattgcactatctgtatcatacctacattttatattatttgtaattacgtgttaaagataaagcttatttacgacggaatatcctccttttaaatagatttaagaatatagccctacaatataaaatatcaataaataaatattatacccctaatttgtatatgttgattaatttgggtttctttgcaaaagaacgtcacccgaagagaaataatgaaatatttactgctttttatgacctttgccaagataggaatgttcactatcggtggtggatacgctatgatacctctcattgaacgggaaatcgtaaaaaagagatggatgagtaaagaagatttcatggaaatgtttgcgttgagccagtcacttcccggtgtttttgctgtcaatatatccatattcgtcggctacaagctgcataaagtaaaaggcagcctggtgtgtgcacttgccacaatcctcccctcttttgtcatcatgatgctgatagccatgtccttcgctcatttccaggacaaccaggtgatgatacgcatctttaatggcatccgtccggcagtagtcgcactgattgtgataccctgcatttcggctgcacgggcgctgaagctgaagtattggcaaccggtgcttccagccatcgccaccatactcatctggcaattcgggctatcccccgtatacattgtccttgcaggaattgcaggaggaatgctctatacattatggttaaaagataaactgagaaaattacagatatgatttattggcagctgatattggtatatctgaaaatcggaatgttcggttttggaggcggttacgccatgttgtccctcatccaatacgaggtggtggaccaccatcactggctcaccctgcaacaattcacggacgtggtggccatctcgcagatgacgcccggtccgataggcatcaacagtgccacctatgtgggctatgcagttactcaaagcgtgtggggagctgtcgtggccaccgttgcagtatgccttccctcgttcatcctggtattgctcatctcttacttcttcgtgaaatgcaaagacaacaaatacatcaaggcggcaatgtctggactactgcccatgtccgtatcattgatagctgctgctgccctattgctgatgaacaaggaaaatttcatagattacaaaagcatacttatctttgcagccgctttcggcgtgacgtggaagtggcaccttcaccctatcttactgataatccttgccggaatcgcaggattccttctatattgaggaagcggtagagacggacaccatcttgcgagcatatgcccataccacgcaataggcaaccagcggtacaatgaacgcccacaccatcgtcgtatggtctgccaccagtcccatcaacagcggacctaccacgcctcccacgggagacatcatcaggaaagaggaagccctcttggtatggttgcccagcccgcgcaaggaaagggcaaaaatcgtgggaaacataatagcctcaaacgcatatccgcacaacagagctgcaagcgatatcatccctacatccagcagtaccaacgaagtagtcactactgtccccgtagcacacaccagcaacattttctcggcacgcacacgtcccataatccagctaccggcaaaacgtcccaacataaataatcccagtccaccgaaagaaagcactacggaagcttcgcgggcattcatccaattctgctccaccacgtaattgatgaagaagctgttgatggaaatctcgccgacctcataggcaaacaaggctatcagcccgaaaatgaaaagccggtgtgaccacaatccgaccttattaccagcttcgtccacctccacactatgttcaatctcgggcaacttgattcttgaaaagaccagcgctaccagcaacacaattacccccatgcagatatagggcaatgcgacattacccgagcccgtctgcccatccttcgagaagagtagcagtccagccagtaccggcgcacagatacatcccagaccattgaaggattgtgcgaaattcagtcggctggcagcagtttcctttgcgcccaattctgtggcataaggattggcggcagtttcaagaaatgtcagtccgcagcctatcacgaacaatgcaaacaagaaaagattaaaagacagataatgctgcccggggataaagagcagcgaaccgatgccgtagagcaacaaaccgaataccacaccccggcggtatccgaagcgactgatgaaaagtcctgcaggaatggccataatgaagtatcccatatacatcgtcatctgtataaaggccgaatgtgtcttcgtgatatccagtatctcttgaaagtgcttgttcagtacattcagaatggcatgggcaaatccccacaaaaagaaaagagaggtaatcaaaatgaagggcacaaggtattgtctgcccaccaatggtattcgtttctgtttcataatatgataattccagacaatcgttgcaaggcgattgataattgcgggtgcaaagataaacaaaactcccggtctttacccaacattttcctattcgctattgtacggagcagctttttctctaactttactgccatcatacaatgttaagccatgaaaaatgccatcccacgatacaatttctacaaaactaagtacggaagcgaacttctgatagatgtcgttgatttgcagtatacccggaaattcttgacccagggaaaagtacatattctgacctactatgacatcaccttcatcacagaaggagaaggagaattcactatcggtaaccggacacacttggcagctcccggtgatgtattcttctccaaaccaggtgaggtgcgcagttgggacacagaccgtatcggcaacggtcatgctctaatttttgaggatacctttttgacctctttcttcaaagacccactattcgtgcagcacctcccgttcttccgaatgggaaaaacggcagacaaactccaactgccgaacgggctctatgcacggatactccaacttctgcacgacataaaggtcgaaatcgactctttccacccacacgatacgggcatattacgcgccttactttacgaagtcctcatgctactcaaccgtgcctaccgcacctctatccctccggagacgggtaaggagccacataaagatatcagcagcttccacctcagccgattcttcgaattggttggggagcacttccgggagcagcattctgtacaattctatgccgataaactatgcatcactcccaactatctgaacgaaatcctctcttcggccataaacatcaatgccaagcagtacatactcaacaagattacagacgaagcccagcgtctgctcacctacaccgacctccccatttcagaaatagcctctgaacttcatttctcaaccgtctcctactttgtacgtagtttccgacaatgtatagggtatactcccctcgcctaccggaaaatggagaaaccgtgaaaagtgacatatcctccttcttttttattgtacaaaagttccacttaccggctatctttgcccttgaaacaataacccataaaaaaacaaacaatgagaaatgcagaaaaaacagtaggaaacatgattgacaaggaaaaaaccatctttgtcggttcgatggatgccgaaggctttcccaacatcaaggccatgttgcaaacccgcaaaagggaagggatcaaacacatttacctatcaacgaacacctcgtcgatgcgcgtttcgcaatttctcaaaaataaccgggcatgcctttacgtctgcaacacacgcttcttcaagggcgtaatgctgcgcggcacgatggagatactgacggacagcaccagtaaggaaatgatatggcaggaaggcgacactatgtactaccccgaaggagtgactgatcccgattattgtgtcctgaagttcaccgccttcgccggtaggtattacagcggatttaaatcagaagacttcacgatagaataaacgggccatccgttccagtccatcagcaagcagagcccgggggcaagcgatattcagccggataaagccctctccaccgggaccgtacatcgtaccggaattgaccatcaagtgctgttgttcttgcaaacgcaaggcgacagcatctgagttgataccagaggcactgcagtctatccaaaccaaataagttccttcgagtggcaacacgggatattgtggtaaccgttccttgaaaaagcggcagaggtattcgtaattcccccgcagatatttccgcaaggcatcgagccattccccaccttcgttataagctgccattgtggcgattacgccgaacggattgacgtcgcatacctcgttgatattgatggctctgtcaatacggcggcgcacctcttcatcggctgcgatgatattggcgatttgcaacccggcaaggttgaacgccttgctcggcgaaacgcaagtaacggaattttgcaaaaagcgttcagacaaggaggcaaagggtgtgtagtcatatccttcgtaagtcagttcacaatgaatctcatccgccacgacaaacacctcattccgtaaacaaatatcacctatatgctgcagttcttccggagtccagacccgtccgaccggattgtgaggattgcacagcagcaggatttttgctttcggatcggaagctttcctttcaagatcggcaaagtcgattacgtagcggccatcctgataaatgagattattggcaaacaactcgcatccgtcattacggatagatgaatagaaacaattataggcaggagtctgaacgatgactttatcacccggcatggccaaggctttgataatggctgacagagccggcacgagaccactcgtatagataatccaccgggaatcaacctgccagcgatgccggtcatcgaaccaccggacaaccgcatcataataggcttcgggtacttttgtataaccgaaaataccgtgcgccacccgcttttgtaaggcatcgataatagcgggtgctgtacgaaaatccatatccgccacccacatgggcagtacattctcctcttcgggaatatcccatttataagaattcgtcccgcgacgcgagatgattgtatcgaaatcgtatttcataatttataaatccagttaccatcccaaagcctcaactcacaatcggcaggcgcctttatattttcgtcgagaatgatttccccatagctttcggcagtgatacagcctgtccgtggattcttcaccccgcctattgttcctttgatggttgcctgcaccgaactatattcaaaagcccggtcgcagtcgggaccaaaggtgcaattctccagtacgaggtcgtgggcatagcagagcggttgctcaccggttatatggcaattcaccaaccggagattgtgcgaatgccagccgagatattcgccgctgagttcagaatcgtagattgtcacattctccacctcccagaaggcatccttcgtagtgattttggcattgcgcaactccacattcttcacatactggaaaacgtacttgctgtcgctttccaatccgtctatgcggatgtcgctgctgaacatgaacggataagttcctccatgcagtttcagatttttgatattcagttttttacaacgccagaacacctcatcggcatcgtttatctctacattctctatttcgatgtcgtgcatctcgcgaaacattttgggtgcatcgatacgcgtatcagtcattttcagatggtcggaataccacagtgccgaacgcccgccgacatcgaaaaaacaacggtcgataacaaatccgtgaacatgccagaagggataatttccttcgaaccgacaatcaacagcttcgatgttgctgcattccttgatggctgattctccagcacggataactacattctccaaacgtaagtcatgcgattcgaacaaaggtctttctccgccaaatgctgtatttgatattattttcaccttgttttcaattttattattctattctctttatcaattttgcggggacaccacctactattgtatttgcttccacatctttcgtcacgaccgctccagctcccaccacagcattgtcaccaattgtcactccttgaagaattgttgcattagaacctacccagacattcttgcccagtacaattggtgccggataggtagtttggcgttcagccggaggcaaaccatgattgagcgttgcaaagactacattatgcccaatttggcatccgtcgccgattatcacaccaccatggtcttgaaaatgacagcaggcattaataaatacgccttcgcccactgttatattcttcccgaaatcggcataaaacggcggaaatactcggaacgatgacggaacttgataaccgaacaattcggatagcaactcacgtacttcgtccggcgtatagtatgcggtgttcagccggaaagtgatacgcctggcttcactgctcatttcgtccataaaacggtgtatctcctccgtattaagcgcttgacgcgtctttacatattctttgaattcgttcgtagtcatagtttctcctatttaagtttatcgtattcttcatccgtcaccggttctagccattcattagaagtatcctcaccgggaacttcgaaagcaagatgggcaaaccaaccatcagaagcagcaccgtgccaatgcttcacatttgcagggatatggataaccgtaccgggtagaatctctactgccggcttgccctcttcttgataccacccacgaccggcaacaccgataagcatctgtccaccgcctttagtagcacggtgtatgtgccagttattgcggcaacgaggctcgaaagtgacgttagagacggaaacctgctcacgtgaaacgggagcaagatagctgttacctatgaagtactgtgcgtatgctgtgttcggttctccaatggggaaaatcatttcacgctggaacgcggctttggtatcttcaccggcagtgtcctctgcccatacgcctttggccagattaaacgctgcccacgctttgggccaaccggcatagaaaccgatatgggtgatgatttcagcaatctccgtacgggtgatgccgttcttttttgccgactgaaggtggaacacgagcgaattatccgtgattccttgactgataagagaagttatagttaccaaactacggtcacgcagaccgagtttgtcggtgcggctccagacctcgccaaagaggacatcgtcgtttagttccgcaaatttaggagcaaactcacccaactgggtacgtcctgctgtctgtactatcttttcttgtgccataatattgagtgttaaaatgctgaatactgaaattaaaaaaatcttgttcatagtcgttctatttattgcatgaagttattgagcttgttagccggattaagtggcgtctggtcagacaagaccaatgatttgaccatgtgcaacgttccttgcttgtatttctgaaagtgttctgatgcaatatgtttttcataagccgcacggctcgcataggtttcgagaatagtcaccttgcagggattctccttctcgccgaccgcatacatagtcagcacgcccgattcgatgcgcagagagatttcgcctacttcggttgcgtatttcatatattcgtcgagatactgcggataaacttcgattttcgacaaccgcacgataccgtcagcactcatcggctctttagcgcacatacccggctgcttatccagattcaggcatttgccgataatctctcccgtggcaaggtaggaataggtcggaaattcaaacaatacgggtttcagcttcgtatagtcaagtttcccgttattatcaagcacttcaggagcagcgtatgtattgactatcgcacaaatgaaattgtcgaaaccttcagtttcatagatgtctaccacctcacactccatggtgaggggtgatgcgtctataacaggggtaccgttttcgccaatatggtaggcaaacacctccgacttatcgaccgtcgcaccgcttacacttcccacatagtcagctttcggcaatatttcacgactcactagattgacggaaagtcgttttgaggcctttatcccttgattagtgtaatggcttttactcatgctgatgagtatccggtcatgtccaataacacccgtatggcctaccactagccagtttactttcccttcaacctccgccccgacaaccgtcatcggcttgggatagagagccaacagatttccgagatttttcttgttcgtttccattatattgggttgaacggtgttctccttcactgggatactgcacgacattatgacaagcagtgacagaactcctaaaattatttttgccatacgctatattactctatttttcttgttaaacttctgatgacaaaggtaccgcgatagcacaagcgaaggtgtatatgatttacggatatttgtacccgaattcccgattataccgcaagaaagttcaagttcatcagatgagtatagtaagactggcagaaatcccacgaataatcccatgcatgattttttaatcgttattcttgccgatacagaaaaaaagctctgaaatccttgaatttcagagctttgctttaatttgatatttgctttcgcggtgcgtacgggactcgaacccgtgaccccatgcgtgacaggcatgtattctaaccaactgaactaacgcaccattatttcattctttcgttgctatctctctcgattgcggttgcaaaggtagacaaaattcttatatctgcaatagcttgaaagaaaaaaaatcatcttttttttaacatagcttgattataagagatttatgttacctttgcaaaactaaattaatattgaaatcatgagaaatactcctattgaacgtaagttgatagatgaaactatcgcagattttcatatcacagactttgccaaagcaactatccgtgaagtcaaagccattgcagccaatgccgaagcggcatcgggtgtggaattcataaaaatggaaatgggtgtacccggactccccccctcagccgtcggcgtaaaggcagaggtggaggcattgcagaatggtattgccagcctctacccggacatcaacggactccccgccttgaagcaggaagcatcccgtttcatcaaagcctttatcaatgtagatgtagcccccgaaggttgcgtaccagttaccggttccatgcaaggaacttttgcttcattcctcacatgcagccagtgcgatgagaaaaaggataccattctcttcatcgatcccggtttcccggtacagaagcagcagttggtcgtgatgggacagaaatatgaaacctttgacgtatatgactaccgtggcaacaagttgaaagcgaagttggaaagttacctcagcaaaggaaatatctctgccatcgtctattccaatcccaacaatcccagctggatttgcctaaaagaagaagaattgcgcatcatcggcgaactggcaaccaaatatgacgtcattgtgctggaagacctcgcctactttgccatggacttccgccaagacttgagcaaaccgttccaagcgccttaccaaccttctgtggcacactatacggacctttacgtgctgctcatttccggttccaaagctttcagctatgccggtcaacgtatcggtgtcagctgcatttcggacaaactgtatcatcgggcctatcccgggttgacacaacgctacggcggcggcaccttcggcacagtattcatccaccgcgtactctatgcgctctcttccggcaccagccactctgcgcagtatgctcttgccgccatgcttaaagcagccaatgaaggtcaatacaacttccttgatgaagtgaaagtatacggtgaacgtgcccgccgcctgaaagaaatcttcttgcgccacggtttccacttggtatacgacaatgatttgggtgatcccgttgccgacggtttctacttcaccatcggttacccgggcatgagtagcggagaacttgcgcgggaactaatgtactacggtgtaagcgccatttcgctggtgaccaccggaagccatcaggaaggattacgtgcctgcacttcctttatccaagaccatcagtacgaccagttggacgaacgtatggcaatttttgccgagaatcaccccatccaataaaaaatatccctatataaataaggtgtttctaccagttgatgccggtatcccaccacaatcgggtaccggcattgtcatctccacccagtacctctaccaaagcggcatactgctcggcattctccgtcttcagtccgccgggaaagttcagacggcgaatcattgtctcagtatctatgcacccgtctttactgtgattaaagcgtacggggaatagccggggataccccgtacggcgctgttcagcccaagcttcacacccttcgggaaacatggcaatccatttttgggtaataatcttctccagtttcgtatccctatccgctgactccagccagcgtggcgaaacctgacaacgggcggtaatatcattctccatatcgtaggtatccacaaaatcggcaggcaacaagttgctctccagataagcgtcggactgcaagatgccatactgacggaaagaagccattaccccttcttcatagcagattttcgccgactcatcagtccatccccgtagggcagcctcggcacgcaggaaccagacttctgctgccggcatcaacactgcatcagtctgctgggtaactttcaattttgagagtgtattataatagttatgtgcaaagcatgtaccctgacgaatgccgcgatactcgcctgcaaactgttcattctggcaagtggcaaaatagatttcacgacggggatcttcatatccgttcagtatggactccatcggcgctcccatataagcttcattccaaacaaggtttatctcgcccaacggattggtatatccactcgctgtggaaaccgccaccgactcgtccgcctcccgaatgactccgtattcattatccatcgccttacggaattccgtttttgccttctccggactggctaccgcgatgcgcatggcaagccgcatcctcaacgagttggcaaactttatccaagagtcataatcaccgtccaacaacatatcgaaacgcgcaaactccgaagctctcggatgctcgacaatataatcggaaagtacagcaacagccgtatcgagttcacagaaaaaggcattatagacctctttctgcgtgtcaggcatataacgggcttcgggatcggcaaaatgactatacacaatagggccgtaatagtccgtgacacggtgcatcacttccaccttcagtatcttggtaatgccgaaaaaggcaggcatacggtcacgtgtggcattctccgactgatatatctgcgggaaaacatactcataggtatgtccccacatggcgctgttccatccatcctgcaagttgtagtccgaattgtgcgaacctccattcagaggcttggcatcgtgcatgtaaccgctgaacatgtcggcattcaaattctgggtcaattgaaaaggccagttcttcccctttccgtagtcgtaattgaaatagatgccttgctggatgattccaagacggatgccatgttcgttatagtcggcctgcaagtcctcgtccgtcacgccggacttgtccgtattgatttccttaaagtcccgcgtacaagccagaaacacgaaaaccatgccaatcagtactataatcctcttcatatcaagtctccctccccctcttaaaattcacacttcaaagaaaatccccaactacgcgtggtaggcataccgtagacttcaattccctggttatcgttgcccgtagagagtaccaggtcagggtcgaaaggcgcctttttgtagaagaagaacaagttgcgtcccgaaaaggacagttgtgcccgcttgaggactttggtcttttccatccaggcagcaggcagttggtagcccacggacagctcacgcagcctgatgttcgtggcatcatacatataatattccgtcaccccggcccgtccgcctacaacattcttataaaatcctttcacattatctatccggttaccttcaagcattacataacctttgtccctggcccgggccgtgacttcagaaacgccatacatatccatatccgcctgcgtctgagacaaaatatcgcctccaaagcgacaatccaccagaaaatagaaagaaaaattcttgtaagacagcatatgattccagccaagcatcagttttggattggcattgcccactttcaccgtattgccatcaccttccaccaaaggcatcccggtattgtctccttccgtgccgtaaacgatatcgcccgcatcgtcacgtacaaaagcttttccgtagatgtcaccgatagagccccctttcaccaatttcatggcataactggacgagaagctggtaggaccgtaaagaaactccttcagcgcttcgtgcagtgaaattatcttgttgcggttggtggaaaagttcacctctgttttccacttgaaatggttcgtcagcaaaggaacggcatccagtgaaacctcccaccccacattctgtatattacccgcattgacataacggtaggcatatttatcgcccgacagagtaggaagcttgaagaactggttccgggtattcgtcttatagaaagtggcattcaagccaatgcgattcttcaaaaaacgcgcttctatacccgcctcaaaggagtgcgtcatctccggttccatatccttgaacggcgcggcatcacttgccaagaactctccgcctgccgtgatatgcgaggaaggatttgtgatgaacatgggaatatcattgcccaccatgctgtatgccccccttatctttgccagtgacacccatcggggtaaagtcatcagcttattgaatatcagcgaaaatcccacggagggatagaagaacccgcttttctcatgagatgtataagccagcgtggaggaccagtcattacgggccgacaaatcaagatagacaaactcgttgtagcccagttgtgccgtcgcaaacaaggactgcaattggcgccgcacatcaatcttctggtccagcccggcagaaccattcatgatgatattggccagattgaacacattggcatatttcagcgaagctgttttagagtcatagcgggtggagttcactgtcttatcattgatactggcaccgagcaccgcgttgagagagaatgcatcccactgctttttcatcatcagtatggcgtctccgtaatattgggtttcctgatagtccatctcaatataacgcccattggctcccgctaacgccggagcggtagaggcatagaactgctggcgcaccttgtcgttaatatagtctacattgccacgggtctgcaggcttaaccaatcgtttatcttcagattggcggataaggagactatgacatgcatgcggttctccttgctcaatatgcgattggtaatccagtagggattctgctcaaaatcctcgtaggaggtatgccaattctgtatgttcaagtttctaccctcatcataaacctcgaagttctccttataataagcaatatcctcaccccgtggaaaacggtagagccccaccaaaggattcatgtagaaaccacccacggtaggcttgttcttcaccacctggcgcatcaggttcatactgccatctaacttcagacgggaattcaatagaacggaagtctctctgaaagtgaggttgtgcttcgaaaggttatgtttcccaatgatgccatgccccgtagtattggcataggagaaatagttctgcaacttctcattgccgtgactcaaggagatggaagttatggaggtgacaccagtagagaagaagtctctcagattatcgtattcgggaaggtttgcccgttctccccaactgtctacaccatcacttactccatagcggttctgcatcttgggtagcgcaaaagcattgtcgaacatcaggctcgtcgagaaagaaacaccgcgctgcccgtacgactgccccttctttgtagtaatcagtatcaccccattggcagcctggctaccatacaaagctgccgcgggagctcctttcaggatactgatgctctctatatcttcaggattcagattggaaatgccgtcccctccgtcacggttgccagcattggccgtcccgcctatggcagagtatgcttgctcggaggtggagttcagaatgggaacaccgtctatcacgtacagaggttggttgtcactcgccaccgaacggactccacggatactgactttggctgaagctcccagaccggaagaaacctggttaacacgcacaccagctgacttgccggtcaacgaagtgattaagttgggcatttttactcgagtcaattcctcgttttttattaaatctgtggcataagaaagagaattttctttcttttcgatacccaaagcggtaacaatgacattatccagctctatcatattttctcttagtgtgatatgaaaggtcgaacgtccttccacctcaatatcctgggaaatgtagccgataaatgaaacacggagcactgcattatcggcaaccaccagcgtgaattttccttccgaatccgctatcgcaccattggccgtttctttctcctgaatagtggcaccggccagcggaaacccaccttcatccagcacacagccacttaccgtcactttggaaagctgtatttcggaatgccccggacgttgcatacgctcccaaaatccctccgggcaatccgtccatcctatagaaaacagccctaaaattaacatatatagtgtagtatacttcattgtattaaattgccaattacttgcaaatttaagcattttcttcgaataaaaaaaccataaaatctgagaaaagaaacttttaaaatgaaaaacagcgaagaacttttgtttattgtggaatattatgtatattaggggcatgtatagcaatatagatctattcaagatagaaacaaaccatgtggttcctgcccggggaaaggtcttgatttccgaaccctttttgtgtgaccacatgtttgggcgatccgtcattctactggtggaccatacacatgacggcacaatgggactggttatgaacaaacctctccccctattcttgaatgatgtgctgaaagacttcaactgcccggaaaacatacctatctataaaggaggaccgctcagtacagatacgttgttctatttgcacacgctcaagggcattaccggagcattgcccatcggcaaaggcttctacctgaacggtgactttgaagccattaaaaactacatcatgcagggaaattccgttaaaggcagaatcagattttttttgggatactccggctgggagtacgaacagctggaccgggaaattgaagaaaacacttggctggtaggcaaagaaaacatcagctcgctaatggacgaggcagccagcggcacactctggaagaaggcattgtgcaagctgggagcaaaatatgaaatatggtcgcgtttcccccagattccaacgttcaattagtgttgcggagaagttgcaacaatacgacatccttatagcaccctcctacgcgccaccactccctcaaaagcccgcaacgcacaaaaccgcaggattcaaaaaggcggatacttgcctcattatccaccgaaatatggactatcaactgcttcagatataggaaactgaaaacatagtcgcacagcaaacgcaacgcttccttggcataaccattgccctgatactccttccgtatagcaatgcccacctctccccgggcatgcatgggagaaaactctgtaatatcaatggtgcctatcaccgcatcatcctctacacgtacaatcatcatacgcagctggcggtcggcaaacatatcgcattcggaattctcaatatattgtttcaagacaaatctggaatagggcacggtgaagttcgtcacatcccaagtccgggaatcattctccatagcatacatcacttccaagtcttccggctccatagcacgtagacgcaccctttcactacagaaataagatttattcatatcttccagtcggttacatttcttcttctttattgatatgcagttctttacgcaggcgtccatcacccggcaggcagaacagagaagccgtcagtcctatcagtgcacacagtacacccgtactgctcaacattatataataggtgaaaaaacctgcaagcactggtatggcaagcaatgccagccgcacgccactccacaacgcataaaggcggagggcttcgggaagcgtcactacatctattttccggattaatacccatgaaaagagtttcagggatacgggcacgcaagaggcagccagcagaatggttatcgtctcagccatatagatagcacgtacatctccggcatacatacctacccattcgcctccggtttctccaagcaggacgagtaggatggggagcatccagaaataagcaaaagttgttcggacacgcaatgcagtcttctttatttgttcttccatttagtgaattgatagtggataatgaataattgatagaagcccaacacgatcaggcagttccggaaaatggagtgcggttcacgatactgcgtcccagagtcacttcatccgtatactccaattcgtcgccgatggaaatgccacgggctatgacggagagcttcacacccagtttttccagcttgcggtagatataaaagtttgtcgtatctccctccatcgtcgtgctcagggcaagaatcacttcattgatgccaccggcggctacccgctgcacaaggctttctatctgcaagtctccgggaccaatgccatccatcggcgagatgacgcctcccaacacgtgatacaaaccacggaactgttgtgtggcttccacagccatcacatcacggatattctctaccacacagaccacggaagcgtcccgttgcggactggaacagatgcggcacgtctccgtatctgatatattatggcataccttgcaatatttcacttcatgcttcagcgtcacaatggcattgccgaacgcttccaccactgccgtatcctggcggagcaggtgaagaaccagcctcatagccgtcttacgtcccactccgggcaacttggcaaactcatttaccgccttctccaataatgtcgagggaaactgtccattcatacttaaaattttcctattggccacaaagatagtgcaaaccgaatgcagaataaaatgaactcgttcattttttatgctgaggtgcagcctatcttcgctttctgggcaaagatagtgcaaacttatgaaattagtgctacctttgccacacgtaaaaccccaaaaaggcaacaaaatggatattacaaacgccgaattcgtcatcagtaacacagacgtgcggaaatgccccgccggtacatttcccgaatatgctttcatcggacgctccaacgtaggaaaatccagtcttatcaatatgctgaccggaaggaaaggactcgccatgacctctgccacaccgggaaagaccatgcttatcaaccatttcctaatcaacaagagctggtacattgtagaccttccgggatatggctacgccaaacggggacagaaaggtcaggaacaaatcaaacgtattatagaaagttatatactgcaacgcgaacagatgacttgtctgtttgttcttatagatagccggctggctccccaagccatcgacctcgagtttacggaatggctgggcgagaacggcgtaccctttgccatcgtcttcacaaaggccgacaaactgaaaggcggcagactgaacacccacatcaacgaatacctggaacagttgaaggaacagtgggaagagctgcctccctacttcatcacctcttctgaaaaccgcatgggacggaaagagctgctggactatatcgaaagtatcaacaaaagcctgaatagcaaacaatagacataagtaaaatgaaaagattagttttttggcaactgtttgttgccgcactactgctgaccggcaatagtcacgcacaatccatcaaggatttgttcaacaaagaaaatatagagaaggcggtaaatgccgtgaccggcaagtcaacagcggatatgaccggcacttggtcgtataccggctccgccattgaattcgaatcggacaacctgctgcagaaagccggcggtgccgttgccgccacagccgcagaaaagaaactggacgaacagcttgccaaagtaggcatcaaagccgggcaaatgtcattcacattcaacgccgacagcacattcagcgccaaagtagggcaaaagagcatgaagggaagctactcctacaatgcatccacccaaaaggtcaacttgaaattcgccaagctgataggtatgaatgccaaggtcaacgctacctccacaactatggacctgctgttcgaatcggacaagctactgaaactgataaccttcctctccagcaaaagcagcaactccactctgaagagtatcggctcgctggccaacagctacgacggaatgatgctcggattctcattacagaaactgtaacaacaacttccatacaacaaaaaaatcccgcaagcaccgaacaatgcttgcgggatttttttatctgaaaagagcggaaaacgagactcgaactcgcgaccctaaccttggcaaggttatgctctaccaactgagctatttccgcattggatgactctccttttttgaggagtaaagtgcccagaacaggactcgaacctgcatgcctctcgacacacgcacctgaaacgtgcgcgtctaccaattccgccacctgggcataagtcatcttcaatacatctgaaagagcggaaaacgagactcgaactcgcgaccctaaccttggcaaggttatgctctaccaactgagctatttccgcaatgtataaaagcgtgaagagaaggagactcgaactcccacgacataattgtcactaccccctcaaagtagcgcgtctaccaattccgccacctctccaacttactttcaacaattcaaagaaccgactgctttaccttggtgcccagaacaggactcgaacctgcatgcctctcgacacacgcacctgaaacgtgcgcgtctaccaattccgccacctgggcataggtaattgcaatctaaactgcgttgagcggaaaacgagactcgaactcgcgaccctaaccttggcaaggttatgctctaccaactgagctatttccgcgattgcggatgcaaaggtagatattttccttaaacctgcaaacattctgcagacttttttcacacagaaaagtgtacattttcgccaggcatacaagcagacttttgattatcaactcattcgcccacgataatcttcataagaaaattgcttgaaaacttcagcttttccttcttttgtccacattgcaatggccggatggtgaattccattgaacatattcgtctttacagtggtgtaatgtatcatgtcctcaaagacgattctctcccctatctgcagctcatggtcgaaactccacagtcccatatagtcgccgctcaagcaggagtttcctccaaggcgatagacgtaagggcccgcatcgcccatctccgctccacgcactgcaggctgatagggcatctccagacaatccggcatgtggcacgtaaagctaacgttgagaatggcggtacgaatgccgcggttttccacaatgtccactatctccgagctcagcacaccggtctgccaagtaaaagcggaaccgggctcaagaatgatttgaagatgtggatagcgccccttcaagccctgcaacagacggacaagatgctctacatcataatccttacgcgtcatcagatgcccgcctcctaaattcaaccacttaatctgtgagaaccagcgggagaattttccttccaagtgctccaatgtgtgttccagctcgtaggaagaagactcgcagtgacaatgacagtgaaaaccttcaatacccgccggaagttcttcgggaagctggtcggccattacaccgaagcgggtaccgggtgcgcagggattataaagctccgtttccacctcagagtattcaggattgatacggataccgcaggaaatgccgcttccctccgccaccactaccggataaaagcggtggaactgcgaaagcgaattgaaagtaatatggctgctgcaccgcattatctccggaaaatcggcctcggtataggcaggcgagtacgtatgtgccttacttccgaactcctccaatgccagacgggcttcgtagacagaacttgccgtagagtggtctatatactccctgaaaatgggaaaggaacgccacatggcaaatgatttgaaagcgaggattatctccacacctgcgcggtcggccacactttttatcagtgcgaggttctttctcagcaatccttcttccataatatagcagggagaagggaaaagggaaaagtctttatttgtcattcttctatctatatttactattctaaattgtccgtatgtatcgttctaactgtcttttttaagataccacagtcctacactcatgccatcatcctcttacaagtatcccgcctctgtgtgagacaaaagatgcgtactatcctatgacagcactttgaaacgcgcgaagcgcagcaaaagttgtttgtctcccgcattcttgaagcggatggtggctttcgcattgtctccttcgccctccactttcaaaacttcacccaggccgaaacgttcgtgctctatcagttgtccctgctgtacacggttggcagacgcgccggcagaaggcgatgtacttgccgtatttgcagaaggcgccacccgtttcaggttacgtggaacggtcggcgcaataatctgctgcttcggccgtacagacacacgctcttttcctccatacggagcatcttccctatcaggcgcaaagcctctggcgttctccctgcggaaaacggcagcttcctcctctaccctgcggaacattcccgcatcctgaggcaggcgcaggaaccgtacgtctatatccttcagaaaacggctgggactgccaaactccatcttgccgtaccggaaacgcgtctttgcatacgataggaaacagtgttcttcggcacgtgtgatggctacatagaacagccgccgttcttcctccaatgcccggggagagtcacccaccatgctgctgggaaaaagattctcctccatccccactacaaacacattcttgaactccaatcccttggccgaatgtacagtcatcagggttatcttctcatcgtccccatccttatccgaatcctggtcggtaagaagggaaacttccgaaaggaagtcacccaacaacacgttagagtttccttcctcctgccgttgggcgcaaaaatcactcataccgttcaccagctcctctatattctccttacggctcagattctcgggagagttgtcttgacacacatcattgatgatgcccgattggcgaataatgtcagcaccaatctcgtaggcattcttctccgcagcatctgtgataaaggcagatataagttcgcggaatgcctgcaactttcccaccgtacctttattgaagttcaagccatacgccaacggctcacaaagcacggtccacaaactgacattgtgcccggtggcggcagcaatgatttttcccactgtcgtatctccgataccccgtgcaggataattgataatacgtttgaaagcctcttcatcattgggattcactatcagacggaagtaagcgataacatctttgatttccttgcgttgatagaacgacaaacctccgtaaatacggtaaggcatactgcgtttgcgcatggcttcctcaaaaatacggctctgcgcattggtacggtagagtatcgcaaaatcagagtaggcatagcgcttttcacgccgcagttcagctatcttattcaccacaatatccccttcttccacgtcactgtatgcctggtacacaccgatggcctctcccttctccttttccgagaacacttccttgcgtatctgccactggttcttttctatcaggctgttggccgcgcggacaatggtctgggtggaacggtaattctgctccagcttgaagaccttcgtatcgggatatactttcgtaaaatagagaatattgtcaatatcggcaccacggaaggagtagatactctgtgcatcatcccccaccacacagacatgctgatggttcttggcaagttgcagcacgatgctgtgctgtgcaaaattggtatcctgatactcatccaccagaatgtaacggaactggtcttgataacgcgccaacacctcggggtggtcccggaacagcaggaatgtgtagaacagcaaatcgtcgaagtccatcgcatccgcctgccggcaacgctcccaatatctctggtagatgtcgcgaagcgccggaaccttggcagcacggtctccttcgtaagtctccttgttgttggcatagcctgccggagaaaccagatgattcttggcattcgagatacgcgcctgcaccatccccggcttgtacactttctcatccagccccatttccttgataatggaacgtatcaggcttttactgtccgccgtatcgtaaatggtaaactgcgaagtgaagccgatatgcccggcctcgacatgcagaatgcgcaggaatatggagtgaaaggttcccatccacagatggcgcgccctctccggccccatctgacgggctatacgctccttcatttcgcgcgccgccttgttggtaaaggtcaatgccagaatgttccaaggctggtagccattctccagcagataagcaatcttgtaggtcagcacgcgcgtctttcccgaaccggcaccggctatcaccagtgacggaccgtcattgtataacaccgcgttccgttgtccttcgttcagttcctctatataatcgggcatatccgtataatcttaaaatgatgatatttttccttcctttgtttttacggaggcaaagataaaaaaagcttcggagacgtacgaacatttctataggttatagtgtttatatagtaaagttccaaaattaaataattgaaacttatgaatacaatattaacgattttaatgataacagttatgacttacgaaatgccaaaacttccctacactaacaatgcactggaacctgtaatcagtcagcaaaccatagattaccactacggtaaacatctgcaaacctacgtgaacaacctcaacaacctcgttccgggaacggaatttgaaggcaaagacctggtaaccattgttgccacagcaccggacggtgccatcttcaacaatgcaggacaagtgttgaaccacacattatacttcttacagcttgccccgaagcctgcccacagcgagcctaccggcaagctggcagaagccatcaaacgcgacttcggcagctttgagaattttaagaaggaattcaacgcggcagctgtcggcttgttcggctccggatgggcttggttgtctgccgacaagaacggcaaactccacatcaccaaagaagccaacggtagcaatccggtacgcgccggtcttgttccgctactcggattcgacgtgtgggaacatgcctactatcttgattaccagaaccgccgtgccgatcacgtaaacgaattgtggagcatcgttgattgggatgcggtaagtaaaagattcaaatagaccaacgaggtcccacaaagccatgtgaaggacgccttcttgagttataaagacgcaagaaggcgttttcttgtttaaagcagccatctaacatattttaaagaaattccttggcttctaccataagtattcattaactttgctaaacttaaaagttaaacgaaagaaatgaaactcatcgtagtaacagcacccacattttttgtggaagaagacaagattatcacggcactattcgaagaggggctggatattctacatctgaggaagccggaaactcccgccatgtattcagaacgacttttaacgctgataccccaaaaataccataagcgcatcattactcatgaacacttctacctacaggaagaattcagcctgatggggattcatctaaacacccgcaaccccaaagaaccgcacgattattcaggacacatcagctgtacctgccactcgctggacgaagtgcggaacaagaaacatttttatgactatctattcttgagtccgatatataattgcatcacaaagaccggagttacatcaggctttacagccgaagaactacgacaagcagaaaaaagtaaaattatagacagcaaagtcatggctttgggaggcattacctccgataacatcctggagataaaggattacggattcggtggtgccgttataatgggtgacttatggaataaattcaacgcctgcaccgaccgcgattatctggaagtaatccgccacttcaagaagctgaaggaaatggctgattgagagcgcaggtaaatcaaaatttaccgtactctttgtattcaataccggcaggcaacgtaaaatagaaagtggagccttcccctttcttggactccacacctatacctcccccatagtgttccacaatggatttagtgatggaaagccccaaccccgtacctttaatattgtagttcatcttcacaaaccgttcaaagatggcatgtcttcccacttcatcaatgccacagcctgtatctgccacataaaaatagaagttatgattactcaatctcctacaaccgattttcacactgcccatctccgtaaacttcaaggcgttcctcaccaagttacctataacttgggcaaagcgcacgcgatctaccaccaaacggcattgaggcagccgttctacaaactccacctgaatacctgtgggatgcgagcgcatattctctgtcgtgcagacttcatcaatcagcgcgttcacatccgcttctccatcattatattccagggtctttgcctcaatctttgaatagtccagcaagtcattgaccagttgcagcagcgagtccttgttatcattaatctctttcaggaaagccatacgggtttctctgtccagatcatccatttcggcaagcatagttgtaaagcctacaatagcattcaaaggagtacgaatttcgtgagtcatattagctatgaaagcatccttcagctggttggattcttcggcaacctcattaatgcgctgcaacgtcttcaaccttttgcttttactgatggaaatgattatcatgatgaccaaaagcagaatgacaatcatgccaaaactgtatatcaatgcttcatccttctgatagaggccgctggtccagacatcatatgctgccgtaattgttagcatcatcgtttattgcttgcttattggaaaactataaaattataggaagcaaatatactaaagaaaatacaaataaattaatagaaactacagttttttttccaacaaaatgggccgcatgccattaccaagtaaagcatgcagtccataaattcattattcagtattattggtatcagccttcaatggcagcctgtgccactctaatatagctatgaaaatcaattgcaaacacttcctgtgtaagcaaatgtttatttaaagtttaaagtttgatggattttccatcatgacttaaaggcatcgttgaaaagctggcttaactatcagatgcttacactatgctggtaagctctgagcctgcaactcatatctattacttcactaaaatcttgtactcaccacaacctctaccaatctctccagactaggcaactatggttaatactatggttatttctttattggttcacccaccttctccttatagaaggatatctttagataattgtatgctacttattcctttcttatgggttaagaatatatacaatgcatagaaccatttctttaatgatacatgactaccttcaaacattgtaccaagagtaaccgtaaatcttttcttacattgtttacatttatatagtcctttaaattctccattagactttaacttataatgctctttcgtttgacaattacagtgtgggcaaattggttctccatgccatttaatatcttcaagaaattctctgcataatttttcatcataaaaggatttcatcaaatcaataaatgactttactcctcgcatttgtttattcttctttattatttctacaatattgattatttctgtttccaattgacatgttatttttattatataaacataataaaaaaaacctaacacacagaatataagttattaaaaaatagatacttaaataaaacaattgggtataattatcatatacatatatcctgtaattattgctcatttaaacattaaccaagtgcttccaatacgatacttggaacacttggcttttatctgagtataattatcatatctatataaaaaatagaacccgactgccggaaacaatcaagttcttaatgcaaatttaccagtctcccataatcaattcgattaaggggttaatcagccaaatgcgctataatatttggcagatttttactgtaaaacataaaacgctgtgaagcgttctaatcagtttttttaatttggtcataattgtaatctctctatttaaggagattacagtatttatttaccactttttaccaaaattggctgatttacataaaggagcattatttaacctttacaaatcggttttcagtatcagaaaaccgattttttatcgaatttcgactattatccatgatattagaaacaaagtttaacagaactaacttttcgattcacttgaaaacaggcataaaaaatagggaaacctaaaagatttcccctattgaaataagatataaatagatagaattaaaattagtatattaaagtatataattgggaaaaaagaattcgcttcatacaatcaatacttcggttaaaagaaaccgattctttaaaactaaacatagaaaatgcaaacatctttaaaggcctttcctattgaaactctttaagctaatcatgcactaaatcaaaaactatattttcatgaagagtatttattgttcacggacatatgttctgcgatttgctcccactccctttacaacgattttcttccaatgcctaggcagtgctgaaggcaactgtttaataccttcatcggtcaagtccaaaccacaaaaaccattaatcaccatctgaagcaatccgcctgccccagtagtaaaataaggatttgttcctcctgcaccttcagagattaccccgaaaggcggcaactgatttggccggaaactacgcacgaacaattcgtaggccttctcaccatcacccaaccgagcatactgcagagccaatacagaataagacatggcaggccctgttttatcgattttgggctcatagtagagtaaatctctctttatttcctctggttgagttatgacttttaacggatatgccaacaagttcgcatctgcctgtttaataacctgaccatcatatccatcatattctctagtcactccatctgagaatctgggtattcgcagtctctctgcaataatgttccaagaaacagggggtgctacaccacaaagaactgccgctttggaagcatcttgcagagcgcacatcgcagccgcattggtaaatgcattatcattgaccccctcagcatactcatcggcacaaactacattgcaaattgagtaagaaccgtcttcattctgctccacacggcttgacaagaattcagccactttttccatcagaggatatccttcttctcgcaaccaacgcatatcacggctcatacaataataatcccaagcagcaatagcaatatctgccgatatatgatgttcaaaaggacctgtcaaggcaaaagtaggacatgattcctcaccagcatcgtcactttcccaagggaacatggcaccatcataaccatagctaaatgcccgctgacacgctggtttcagccgatcggtacgataatccatcattgagcgtgctattccctgattgagaaaaagcataggaggaaacatccaaaactccgtatcccaaaaaatatgtccattatacccttgcgatgtcaatccgaacggtggtatgctcaagcgactacctgaacgagcgcttgaatataagtgaaaaagagcaaaacgcacggcaagctgcgcttcggcatcacctacaatttgaatatccccttcccataactcattccattgtttcaaatgtaaatccatcagcctatcaaccccttccttagctccataaataacctctcgatcggattcattgcaaggatctataaaatcacgatgcgtacagacagcacctaacaaagcaaaagaaaatgtttctcctttctttagatcctttgtaaatacgtttcgaccattaccagtctctgtaacttccgtttcatgctcaaaaatgaaagtcgaagtagcagagacctgcagttttctatgcctagtcaaagcggaggtacgtaaaagtttcaaattgagtccaaaatccttaatactcttccggtgcactacaggctgcaaaaaatcatcggggacatcagcactattttccaccgacaagccgacaggatctaaagcttttacgttcactctcaccaaacctgcataaggcatactgcgcaaggcgcagatactataagatacttccaacttattggcataaacaaatcgagtctggtgtatggcttctttcatattgatacattgttcccaatcggataaaagttttccatccaatacttccccatccactttcatatctatacagaacgggttaataccacaaatcagcctactaacatcatgtggaacacctgcatcaaacacatgattcagtactacctgcttgacagagaaaggttctttccaaggtaaaataccaattcctccatttcctacggcagtaccataataggtgctatgataatctgatgtctttatactccaaaacagatcttgggcatgaacaaaagtaaatccacacactatccatatcaaagctaacagtatattttttttcataactatattatatctaatactaatgttctaaaagcgaatatgatacaaagaagacagataaaagctattctgcaaaaaatgttttagactgtacgtcccgactatttgtacctaccatgacttcaaaatctccaggttcataaacatattgcaatttcgaattgtagaattttaaatcctcctctgcaattacaaacttaacttcacggctttcccccttctttaagaaaatgcgttcgaatttcctcagttcctttaccggacgaacaacatcggcatagatatcacgcaaatacaattgcacgacttcataaccatcataacctccttcgtttctaacagtaacagaaacaattatttttccacctttctttaaaacattagaacttaataccatatcgtcatatcggaaatgggtataactcaatccataaccaaatgggtataatgggtcattgctatcttctaaataattacttgtataacgattaaacgtacatctatccggatcaggacgacctgtattgtgactattgtaatacaacggaagttgccctacagaacgtgggaatgaagtcgtaagctttccactgggactcacttttccaaacaacacgtcagcaatggcatctccagcttcactaccagcaaaccaaacatttagaatggaaggaacaatagctgattcttcaactagcactaaaggacgccccgtgaagagaagcaacacaacaggttttcctgttttgactaatgcttttaacaagtcacgctgagcatctggaatttccagcatagttcgtgaagcagactccccactcatctcagtacattcacccaaagcagctacaataacatctgctcgggcagctatctgcaatgcttctttcaataaagtctgattatttccacggtccaatggacgcatacccgcagctgccttttcaagattttcatcatagaaaacattacttcctttagcataaaggacttctcctttatcacctaccgcatcacgaatcccttcgagtaacgtacgatgtttagaaggagtacacatcatactccacgttccacacatattattacgtgcattagccatcggaccaatcagtgctatttttcctttagtagaaaggggaagcaatgacttctcattttttagcagaacaaatgtttcagatgcaatgctgcgagcaatagaacgatgctcagtagtataaagctgtttcgatgctcgtagggtatcactatatttataaggattgtcaaacagccctaatttatatttagcttccaatacacgacgacaagccatattgatttgttcttcagtcacttctcccttttgaagagattctttcaatgtgttcagaaaaccagaggataccatatccatatccgttcctgcctgtagagaacgtgctgatgcttcttgcagaggagcaataccgtgcgaagacatttcggcaatggaattataatctgtaaccaacaaccctttgaatccccattcttttctgagcaagtcagaaatcaaccatttattcgcagtggctggaattccatcaacaatattgaatgagctcataacactacccaccccggcatctacagctgctttataaggagcaaggtattcattatacattcgtaatcggctcatatctaccgtattgtaatcacgtcctgattctgaggctccataaagagcaaaatgttttacacaggaaagaatttcatcgttccgttgtaaattgtttccttgatatccccgtacataggcctttgccattaaagaaccaagataaggatcttctccacttccttctgctatacgcccccaacgtgcatcacgacaaatatctaccatcggactgaatgtccaattcacaccatctgcactagcttcaatagcagatatgcgagccattttttcgacagctaacgtatcccaactacacgaaagagccaatggaatagggaaaattgtttcatagccatgaactacatctgcaccaacaagcaagggaattttcagcctactttcttccacggccaaacattgtaattcgtaaattttatcgatgcctttcacattaaaaaagccacctatctcctgcttacgaatcatttcactcagttctccatttttcacagttcctgttgtgatatcacccccagaaggcaaattcaactgaccaattttttcacgcaacgtcatgcgatccatcaaatcactgacacacttatccatttgattatcagctacatcaattcgaggagaggaacatgcttctcctaatatagcaacaaggaatgctagaagaaaatgccaatatgttttcatattcagattaacaattattgtttttattctataacagcagcaaaaccaccgtttctcttcatggtaatagtaatagacgaagtctttgtaacgggagtctgcttgtgtctataatccatagcttgccgattagcattaatgccatcttcaaaactactcattcgataagagcgcccttcttccagaaaatcaagaggaatttcaaatttcctttcctgtactgcattgttggttatacctccaataaaccacttcttccccttgcgcttggctacaattacatactccccaaccttagccttaagcgccttggtctgatcccaagttacagggacctgtgaaataaaacgagcacaatcctcattttttctgtaattaaccggattgtcagccaacatttgcaatccactctcaaaaagaacgaatgtagctaattgaaaagcccgtgttcctacacccgccgaatttggacgtaaagcactgtagagttcaggttgcatacttatcatgggtcctggtgtgtaatccatagggcctaccgcattacgcataaaaggaaggtatacagtgttatctggataacatcccctcatatgttccagacctttcactccttcataggaaacgacattgggatatttatattctaaacctccaggagtaaaagatccatgaaaatcaactaggagatgatgcttagcagcttctttagctacacgttcatagaaattcaccatccactggtcacttctatccataaagtcgattttaacccctttaatcccccaatcttcgtaagtcttgaacaaatcaaaattttgttccacagctacccacgatagccataagataatgcctacattcttgtcttttccatactgaatcaattccggtaagcgcatttgtgaattgggcttgttaggattaagcacagtttcagcccatccggcatccattacaatatatggaacatgaaaggatgaagcaaaatctatgtaatatttataagtatcataattgcatcccgacacaaaattaacatctggaccataaagagctgcatcatgccaccattcccaactagccaaccctggcttaatccatgaattgtcttcaagaacacttttagtagccaatttgtaattcatggtgttttcaatgagctgggaatcgtcgctactaataacaaaataacgccatgggtaattccgatttccttcagtttttgctatataatcagcctctttagtaattttcatactcagatttccatcttctgcaaactccaaaggtgctttggggaaaacggcattaaatccattataaccatttccctttaaaaacatacaaggataatcaaaacgatcggattcgcccaccaatattttatattgcttgcgagtatcaatcaagatgggaagtacggacatcttgtccgtacccttccattcttgacaggtaacatgtgtatactcttcttcataaggtgttttaaaacctgaaggctgttgtaaatggagcagatactcttctggaaaggaaatagcaaaatcttctccaagtacctcaaccttattggtcttacgagtaataaaacgataagctaccccatcatcaaaagcgaagaattcaacggaataacctttgaaatcaagagtaagagcattataacaactcgtaatagaagagaatttaagaggaactacaggcttcaactcttttgagaagctattacgcttctgtcgcaacaactttgggttatctcccaaaatttcatcatctaataataagcgaagataattgtcctttaataaaacttcatcattatagtaaatatcataataaatcttatctgataaacaaaactccacttttatagtcttttcaggagaaaacaaagtcatttttttcttgccatatactgccgtagcaagtagccctattaacaataacagataatatttcttcatacacatgttttattatttttgtgagaatgatgataaaacgtgattatactccttttcactcaaccgcaccatagccccatgccgggagtcgggaatcttacaatcacaaactacccatttttctgcctctatatgctcagcatcaaaacgtacatactcgtatggatatctttctgaaaaaatcatccatcccttaccatcgggttttggcatgagaataggagcttcaaaataagtactgggagtagtgacagggtgctttggatttatcaaagcataagagccggtcaagcatgatgacttagccaatcgaatagatttccctgtaggtacaccatcttccggccacctttcgtccttaataaccgcatagtagtttttaccaattttgcggattatgacatcaatagtggccatctcagattcatccttgtctgaaaaatcaaacaaacgttttggagaagaaaaagagctaaaatcttcagttagcacataatatgtacgcatgcttctccattcatcatctcctttggctccttttttagctgcatgccacgtaacaatatactgtctggaatcctcatcataatacaatttaggtgcaccgaaccaatttctttcagtataataattatcagtaaggataaaaggagatactggaagttccttttcaatactccagactacaagatcacttgaggtccaaagcaatggtttctggtttttctctgaaacaccgatcatataatacctattgtcatgacctttgattatatcaggatgtcctctgtattcagcatttactcgttgattattattcagtttagtccatttgcgtgcatctctacttatgtagtagtacatatgcccatagtcttcatgtcgcatatgggcaaaaaggtaccctccctgaaattgcgtattatgagactgtccctgaacattcgaaaagtaaatgctgacaaggcatacacagaaagtgctaataagtaagtccttaaatttcatgtatctaaattttaattagccaatgcaatatcatcttcccagtgaggacgactataagtttgactcaaatcctttccgtacgatttagcttgttccaccaaataatttggaagtggcatgtactgatgagtaggaagcatttctttagccttgaaacatgcttgtgcatatttattaaagcggattaaatctatttttcgatgtccttcatagagaaactcttttgctctttcatctaatatgacatctaggaaagcctccttggtggcagtttgctgagctgacaaatcacttaaaccacttcttcttctcacttgattaacagcatctacagcttgagaagaaggcgcagcattagatcgcctaacatctacctccgccatcatcagcaatacatcagcccaacgagccaatggaaaatcgttaccctggaaagtcgtattagtttcaatggggtacttataaataatatatccactccatcgctgacccaaatcttctttggtcaccttcccagtaaccgtgccttgattattgacccaatactcatccaatatcacagcccgacgtttatcatttggttcataactatcatacagttttggtgaaacattgtatgcctgcatccatccacctccttgatagttaaaaggtgtaggatttcccttgtcatcaactttagaagcatcgttaggcgtagcaagcatagacaatggaaagaaattaccgctactaacgtccccattggcagaaggatcacaacttaaagccataatgatttcacaattaaaatcattcgcagccttaaacatatcaacataaggattatcccccttcttaaacaaactatatcgattatctttactcaattcttgatacatctgcatggctttatcataatagcctgtcatatgttctccttcattaaggcaatgtttcatcatacaaaatttagcataatctgaagtataacgaccgcgttcctttacttcattaggcagattatccgcagcaaactgaaaatcattataaatccaggtactcatttcgtccaacgaaggtctgactaggttagtcaaagctgcttcattatttatattatccttatccacaattgcaggcaatggtccataaatatgcatgagataataaagcatcaggcctctacacaaatgagcttcacctaacagtctttccttgctgattgttttgaaaatttgatcgtctgcctgctctaaagtagagataatctcagtaaagcgagtaatctgggctaacttaggaatatggttgatattatgctcacccacccatgaacgttctgcgtagacacaatccctgtaatctgcttgagaaagtttcatccatgaaccccagcctaagttccatgcggccatattatcagacggagcctcaaaaactctcagtatacccccttcagggatatagaaactatgctgacccggatcgtttcctatttgatactgccatgttgttgtaaaaggaatatagcacgtcatcgtgtaatcttcatattcactttctgttttaggatagttttccggattcaatgttccgaaaagtttaggatcgaaattatcttcacagccagataaggctaatgatgtaataaaaaacaatatgaaggattttatatttttcataatcacagttattaatattaattagaatacaatgtttgttccaagtgtgaatgtgcgagcttgaggatattcgcctctggatgcattgtttgctccacccccacctgtatatatttcggggtcaaagcccttaaatttactgatgacaaacggattttgaacatctgcataaactttaatgcctttcacatattttttgagtttacccaagattttatccctgaaattataggataaagttatatttctcattctcacaaacgaggcattttccatgtctatattaacgccagcacctccaggcaatgcacccatgcgatccacggccagtccaggacgagtaccattgggattggtttgagagttccaaagcaggtaagcatatttgttagtattttccggatagtctaccgctaacggaccaggtaatgcagctctatacgcaatattagacttaaggattccaaattgtccgtacatgaagaaactgaactcccaattcttataagtgaatgtattgccaaaaccaatataaatatctggtgtattatcttttaggtagatatcattttcatcaatttttccatcattgttcttatcatcaataattggacaacctggaagttgggcttctgcctgcaatgttttttgtgactccggcatattgctgcggtcagcgttaataataccagtcatcttatagtaatagtaggcattcataggttccttgtttcttttttgatagctacgataatcatagttcggcattctttctttccagaacgaattcgttttcgagaaagtcagttgcgtgttccaattaaaatctccgaccatatttttagtatcaagcataatttcccatccttgacgatagaaatggcctccatttataggacgagttgggtaaatggcaagaggtgatgttgatgcatagcccaataagctggtcacatcattgcggaatacatcaatactaccacttactcggtttttgaacaagtagaaatccaaaccgatattcttcatgatagttttttgccaacttacgtcaggataattagttcccattgagacacaaggtacataaaaaaggccattatcattgaagcctaccttaaatccgctaggctcataaacaccataaagtgaactacctaaattatcctgtcctgttttaccataactagctctcagttttaacaaattaatccaaaaaacatccttaagaaatttttcatttgaaattttccacgctgctgaaacagaagggaacaaagcatattttttccctggaaaaaacttatcggttccatctcgacgaagggtcgctgaaatgacatatctatccaagacatcgaagcttaatttaaagaactgagatcttttttcatttttcaatgtatgagaagttggatatatctttccttttgctgaactaatatcatgctcattaatcatgtcgtgtgtatcttcgtaagagataccgtatccttcattgctttccaaatattttcccataccagccatggcatccacttgtacgaaattaaacatatatttcgaaaatgacaacatcgcttctagggtttgtgtctgtctacgctgtgagtaaatatttcctcttgacttatacattctggcaaaatacacatcggatggaatgaatgttgatcttctgacattttcttgattcatgccatatacccctttaaatactagaatgtctttatacaacttcgcgttgatagagaaatttaaactatatccattctctttactatagtccacaatatcctccattgctttgggattaggaatattacggaaaattgtataactcccatcatcctgcttcaccggcaaataagatggatacagaagagctgatgtcaaaacactaggagcaacatcaccctgatttcctgtatcagtaccaattataccattatcatatgtattctgattagcgttaaaaaccgatgtcaagttcaagaaagggaacaaatccaaacctaaattaccatgaactgaatatttagtcatgccagatcttgatacagtaccttgctgcttcaggtagcttcctcctagataatacttaaatttagagtgtcctccgctaatcgtcagattatgtttggtaaggaaaccattacgtaataccaagtccttccagtccgtatcggttgcattttgcatatccgcttcagtaaactggggtttccattttccatcataaggagttgttccataaggatattgcttgttattatacaaatagttttccttattgaaaacattagctaactccatgtactcttttgaattcagaacatctagatatggatagttacgtacaaaagaatagctgccatcatacacaatattaggtgctccttcttttcctttcttagtagtaatcaatataactccattatcagctccaataccatagatagccgcagaggcatctttaagaatttctacagactccacatctgccggatttaaattggcaataccattacgatcgatattattcggaagacccacttggccacaattaccactaagggcgttattcggcataacgataccatcaattacatagataggatttcctcctccacgaattgatatattcacctttccatctggctgcatactattcactgttgcctgtaacccagcagctcgtcccatcaataattggttaacatggctggtaccagcttgtgaaattttatcagttttcacttgcgcaatagcggtcgtaagatttttcttcgacacagagccataacccacaactacaacttcatcaatgagttttatatcttcactcagataaatttctaaaaacgatttatccagcacatcaagcacttgcgactcatatccaatataagaaacaacaattttcttatctgctgaaacatttattgcaaaattaccattaatatcgctgattgcgccaattgattccttttccaccgcgatacttgccccaattataggttcccctgttttacggtctttgattatacctttcaacatttttgtattggtctttaccgttttttttgcgctcagtataatctgtctattcttgatttgatactgaatagaagttcctttcagcaaggtttccaatacattatgtattgtttgtttatcaacatgtatagtacgcttttgacgaacatcaatcacctgtttactatactgaaaagaatacgctgttttctcttcgatcttgcttaacacatgctccaatgatacattatccaaatgaagcgttattttctcgttctgtgcccaaccaattccagtagataacagcacaattaaaaagaataaaaaaggatactttttatttttcatagttttaaaaatttgataattatattttgtctttattgctttgctaattttagccaattctttcccgtttatattaaagactgtttagaaagaaaaccccacataaaaacacctaaaaatttttagtttttttcgtcagcctaccaatatcatcgtaaatatctgtaatactatatattaatgatatggcaaatatgaaactatttcagttcgaaacaaactttagaacgaatatcagcagatgaagaagctatcaaagcttcatattttcctggctcagcagcccatttatgctgtttgtcgtcaaagtatgatagttcttcagctgtaatagtaaacaaaccctctttcgtttcatttggctgaagttctactttacaaaagcccttcaattctttaatgagccaaattacagaaaatttcagacttttaatatatagctgtataacttcagccccaacacgtttgcctgtatttgtaattggaagagtaatacataactgcccactcttgtccatagacgtgctacttaccttggggtttccatactcaaatgtagtatagcttaagccatgaccaaaagggaaattgggtgttaacttgtttttatcaataaagcgataaccaacaaataatccttcgttatagggtatgtcataaacctcatttcctaaagcatcgacacctttgtgacctggatattcgtccaccctgtgagcaccacactgatcaagacccgcataataagtatatggaagcttaccactaggactaacatcccccatgagtatagaagcccaaacattgccagtttcacttcccaggtaccaagcttgattcttccaaggcatagctacacctgttccactgatgttgattacaaccagttttttattaacttgcagtaaatccataatcaatccattttgattataaggcaaatccattgttgttcggtccgtaccttcacaatcctaatagttacttttatttagtcctcctataaaaagaacgatatcagcattaccagctgcgtgcagagcttctgctccgatttcttctggactacggtcatccttcaagttttgcccagtttttacccccagtaggatcacctacgtatccacgggcatatatgatttcagcttgtttaccaatacgttttctcagtccttccaaaggagtaacttcatacttggctttcaaagaggaagagccacctccaacagtcatcattttaatggcattttcaccaataacagtaatacgtcttacctttgataaatcaattggaagtaaattttcattgttttgcaaaagtaccataccttctgctcctacttttcggcaagcatctttatgtgcatctgcgaccattgatccccagggtcgatcactattcatggcagtacgaaacgttagtcttaatactcgacgcaccttttcgtttaattctttatcagtataaatgccttcttttatacctttcaaatatgggtttgccaaccaatagttatcataggcattgctagccccctctgttaacccatctgtccagcttccgaactccatatccaagcctccaataatagcagtttgtgtatcatgaacagctccccaatctgatatgaccgcaccatcccactaccattcttctttcaaaatctgattcatcagtattggattataactagcgtgttcgcctcgaaataaattatagcctcccataaagtaccaagccttaccctctactgcagctgccttaaaacctggaaggtatatttcataaagcgtacgatcatcaactatcggattggaagtgtgacggttgattttattattatttaaagcaaagtgcttcatgcaggcagaaaccccattgctttgcacgccctaaacatagggtaccaccatacgactaatcaggtatggatcttctcccatatactcaaaattacgtccacaaagaggagttctataaacatttatcctaggacctagtaatacacttttgttgcggaaacgagcctcttttccaatgcttttataaaataaagccatgtcgggattccatgtagccgccagacaagaaagtgcaagaaaagccatgcaagaatcattggtccaacctgcctgatcccattcatcccacatgacctcaggacgtatgcccattggaccattagtacaccataattccggaatacccaatctgggcacaccaggagcactgaatttagattgcgcatgaataatatttattttttcctgtaaagtcatacgagaaagagcatcctccacacgctgttttattggttgatttttatccaaatagactggagtttgcgctgaagcggatataccacaaaacacaaaagcgcaaaatgtaatagttttcagtgttttaattttcatatttagcatttttgaattgtaacaaagtctattattgaaagaaagctaccacttatctcaaagaagttaaagagctgcgcgtaacccccttaaacgtcatttttacaggttttatataaccttcatcatcaaaaaacatccgttctatgcaaacaacacgggcattcccatctgtttcatttaagggatggcgatgatacactatataccattcatcatctttcaacccctttatcacagaatggtgtccagctccagtagcaacctcctcatcttgttccaatatttttccgactcgcttaaaaggcccgaatggcgaatctgccatggcgtaagctacacaatagtcaggaccagtccaatcaccttctgaccacataaaataatacttcccttgatgctttaacataaaaggcccttcaacataattgtctggagttacttccttacaaagcgagccatcttcaaagggaacaagatgcaacaaatcatcacttaatttcaccatattgcaatgcccccaacctccataatacatgtaataactgccatcatcatccttgaatacaaactgatcgataggttgtgccccgtttattatctcattgattaatggcttacccaaagcatccttaaacggcccttctggactatcagcaacagctacgccgataccaccaatttcaccttcgtggacatcattagcagaaaagtacagataatacttttcattagcataaataattgcgggtgcccatagagctttttccaaccaggatacattttctaccgaaagaattttggagtgctttttccaagtcacaagatcgggtgaagaaaaagcatctaaaaatagttgctgctcaaatggagctgaataagtaggaaaaatccagtaacggttgtcaaacactaccccttcaggatcggcataccatccttcaaataacggattgccactttcttgaacagctttcgtattgttcagtgaacacgacgaaaagaattgcccacctaacaatacataaaaaactaataatttgcactttatatttaacatatgagctctattaatcgaagtatggatgcagccatattcactgcatccatacagttaaagatgtattatgacttacttaacctcagtcagctccaacacccagctatcatactccttatttaaatcaagagcaaaaccggcattcatcaaaagatcaccggaaaaaatccgattgtgtaaataacaaggtttatcatctgcagccaaatttaattctcttatttgatacttcttgtttttatccaaaccatccagacgcacatgatgtaatcgtgggttaacatagtgttccattttaaaagcaaagaacactgcacggtctttattctcagtaacatacatcattgacgcaaccgctttcttttcatacggagaaatcagacgatattggtctccatactgaataaccgtacgaatccctttataagtgtcaatggcctttttggaaaattctttttcatctgcattcatattcttaggttgaatttccatacctaagcgaccagtcatcgcaacatcaaaacgaaatttcaatggaacaagacggcctgtctgatgattggacgatgcacttacatgctgagccattgctatagatggataaaagtaagatgttccccattggatgaagaggcgctgcaaagcatctgtattatcactaacccaaaactcgttgaaataaggcatcactccgtagctggcacgtccgccaccactaccacaagcttgcataactacatcagggtatttagcgcgaatcctttccaatacatttattaagccacggtgataatcaatataaatatgtgattgtttatcctttggcaggtagcttgagccatagttcattatttctccattagcatcccatttgatataagcaatttccggattcttactcaatagcccatctactacactgaaaacaaaatcctgaaccttaggattacacaagtccagtactacttgtgtaccaccacggccacacattaattctctattcatagaacgcagtacccaatcagggtgcttttcaaccaactcactttttgtattagtaaattccggttcgatccaaataccaaacttaatcccatattttttagcagtatctgtaagtcctttaataccatgagggagtttttgagtgtctactacccagtcacccaatgatgaattatcttgtatacgacgatatttattcccgaaccatccgtcgtccattacaaatagttcaccacccatggctgcgaaatccttcatcatctgatccatttcttgttccttgatattaaggtaaaccccttcccagctgttcaacagaatatctctcggcttatcacagctatataccatacccatacgagcccatcggtggaggttcctactagcttcacctaatccttcacaagaataagtaagagcaagtttaggagtagtaaatacttcacgtggttcaagtttgtattcagaagcctcttcattcataccggcaaaaacatgatgcacatgactaccatacgtatcatcagaatctatcctaattttcgtacgtccaccccaacacagaacagctccaataacacgtccactattttcctgaggtttaccatccaatgaaaacataacctctgagtgttcacccaatccgttacgtactccatccatattttttataactttcatcccagaagtcaacggttctgtagtaatccgagtctcagtaccccaatgtccggatagagaagagatccacacgtcgcctctacgaatcataaaatgacctgaatcaaagcgcttaagtactaccgctttcttttcgttatgagaatattcagtccatgtttcaataatatccaaattgttgaaagcccgaaaattcaacgttacataaaaagggtaaactctgtcttttaaatgaatcactgtaagctttgcgcttttttcatccaaagtttccactttgtctacaatcaaatccaatgttaagttaccatcagcatgaaccacctgtaatgctgaactttcataagatgaagtaccaaataccggataagctggacggctcaatccattccacgaatcaaagacctgatctatttgattctcattaattctgtcaccaaaataagcaaattgcaattgctgaccctctccccacgtattcaataaaatagatgaacggggagtagaaattagtactttgccattccatgcctgaagaataccagcaggatataacaagcataacaataatacataaacgattttcttcattgttttaaattattcagttaaacacattctagtaaattgtactcggattttcatttaaagaaataaacggatacgcaaagattggcgggcgcacagcgcaagtgtaaccattaaagtatctgctcatagactaatagttaaaaggttaattaatatatttatagtaatgctatctgtaatacaaagaataatacgcataatgtgttaagtaaccacacactataaatttccacctattcatgatttatagactcatgaactcaattcctccattaaaagatttaggcggccatagtattccacgcataacatttttaagacggttaacaacgtgatcaccacagtatattaacacttttttatatatagatatcaaactatttacataccttacttcaaaaaaagaactgccaatctaccagatcattctataattataaatatgaagaagacagatatactattaaataataaaggttatgtatgctaaagctatgtcaaactgaacacaaggaatgagccatatagagcataccttaacacatatccaattgatagatttttccaaaagaatcttgcataattaaaaggatttggctaattttgaccatgttctatggttcagttttttcatgtgaaaagcggggacttttctttaacttactgaatttaaggatattatcaacttaaatacttaattattaattaattagttagttataactttattttttgtcatctatttacatatttaccaaacaattataaatctaatagttatagaacacgcaatggaagatgaacaaacaaataggacaaaaagtgcgtcagaagattctttttacataaaagagcttaaacaaggaaatataaaagcctttgagtttctatttaataagtattataaagaccttgtctatttttgcaacgtttttctaaaggaccaagaaaatagtgaagatttggtacaggatatctttgcacgcttatgggaaaatcgagaacatctcgatattaaaggtgctttaaaatcgtatcttatgactgccgtgaaaaacaatagtttagaagaactcaaacatcagaatgttattagggtctatcaagattatgcaattgctcacaatgacccatttgactatgatgtagaaaactatattttatactcagaattaaatcaacaacttcaaaaggaactgaataaactccctaaagaaatgagggaagtatttgaaatgcatcgatttaagaataagaaataccatgaaattgccaatgaattaaatgtatcagtgagaacaatagaaaatcgaatcagcaaggtgttagaggttttaagaaagaacatgaaagggttttataactttattttatattcttttttataaaaaaatggtggtatattcttttacaacagtcttataattaatagtttgttaagaattcgccaagcttaagcggctctggctgtaaataaaatgagttctttgaaaagtttgtcaataacttgcatgtctgggttaatcccaaacacgcaaataaatcgttcaagcatataagcattgtgtatgaatgacttgcaagaggatatggaataggctattccgagcctcttacatgccgctttggccaagttgacagctgcaagcgatgcattgaagtgaaaattcaactttctgaagtcagttaactgacagttggtgattcctgcatgttgctttccatctctaaagcaaaattccaactggaacctggttctgtaataatccaagacttcgcgtccatccatggaatcgtctgtagagaaataaagctgccacttgtctgtcctcccgtccatcggatatcagacggctaaggaaacataccttttgagagcttttgcatatacactcaatccgtacagctttcccttgttcacctcgtattccttgcaccgggtcagatctagattggcaaagtcaatcctgccgtcaaaccacttgggatggccaggttttcctgttttcttttccaatgttggatagtacaggactacgtcattcctgaagcggctgatgacatggaaatcactctcacacataggcgttatgaacgtttccttggaaaagaatgcgtctgcaaccaccgttctgaatatgctctgtagctcgtcttttctactgataagatagttgctataccagtcaactaggttcttacccatattatccaaggtcttacaatccgacgtctgaatggaacctaaagtcatgcattcatggttgtcgatgtcaatgacaccgatgcccatgatttccaatcttcgcttataatccccggcacagcctgaccagaagaccaatccaaggtgtcttatgaccggacttggggatataggaaggatcgatggtgatggcttttcttttgcctatgagatgcttgctgatgatagaggcgttgaacgcaaaccggtcgaaagtttcattcccaaaaaggttacggtatgtctgttccgaaaaacatccatacctgcccaattggaggaaatttatacgatccgggatggccatgaataatttcatggtgtccatgaacgttttttcaaaaggtttgtgtatattcacgactgatttgagagccgacaggcactcggattggtattgcataaggagtgtttctttagccataaccagatgaatagttaacttttaatttactaaaaaatcaacaaatcatgcagcacttttacctttgttatcagcatgttagctcacttttttcagcacatttcttcatgcttaaccattcgtttttgacaacatttcaatgacctctttaatgttttcgaaccgactcttgccggttctattatttaacttttaatatttcggtaaaaatttaccgaaatattgataatttgaaacgagattaaaatatgagagaagagaatcaatatagaatagctgaacttattctgagatatttagaaacaaaggcatcgctagaggaaataactgaactaaaagaatggattagtctttcggaagaaaatagaattttttttcaaaaaatgagaaatatttgggaaatgacagatccttccactagtcaaatgaacattgacatacagtcggcattactcaaaacaaaagtcaaagcaggaatcgaaccaggaaaaacgaatgtttccacacccaaacaaatagtactctattttcaacgaatagctgctattctcttttttcctattctgataaccttgttcaccctaatgatgaataagaaagaagagtcgctgacctattataaagcgagtacaccttacggttctatttcggaaattattttgccggacagctcgaaggtttggttagatgctggtagtacattggaatacccttcgcaatttataaataacacacgaagggtatgcatgagtggcgaggcatactttgaagtacacgctgataaaaataaccctttcatcattcaagctgatgaattggaaattacagccactggtacggcctttaacgttgctagttttacacatagcatggagcaaaaaatcacattaatatctgggaaagtatctgtttcacaaggcaaagaaacaaaacacctacttcctggtcaacaattaacctaccagcgaaacaccaaacgtatggaaataacttccaccgatacatttaaatatatagcctggaaagatgggatcatcgcatttagagatgattctttagaaactattcttgatcgactagaacaagtctataaggtccgatttgtcatgaaagaccttgatataaaacaatatacatatagagcaacatttaaaggagagaatttggatgaaataataaattgtatggaagaaggggcacctataaaatttcgaaaaaggtataacgatttcaagcagggagatacacttacaatagaagtaagtaaaaagtaacccgctatcggaatttacaattataaaaccgttgattggtatcagacatacacaaatctataccaacaatgggttttatatgattggccttttaaagataaataacaatagccgcttagtgcattagtacgaggtagatgagagcacttttcagagaatggataaaatcaatagtaacgatgaaataaggtgaattagtcaagacttaatctgacagttacgtataaaaagaataaatttgtaactattcttaacctgaattaagctctcgcaccggtgattttgcataaagaaagcccggtttcctttatgaatagaattaccgggcaggaaagtaagaagagccccatataggctatataggctacaaaaacgaggtcaaaaggttagtgttcttagcacgctcctctttctcgaaactcgccagatatgcttccgtagtcctcaagtcggtatgtcctaaggattcacttatataagagatattggctccgcttcgtttcaatacggtagcgtatgaatgtcttgcggtgtatgtggtgatattgccgatacccaattcttcacctatcaacttcatacgtttgttgattcgcttgacaacatcacgtacaatcgctttacgctctatggctgtctcatgccctttcatataaggaaatatgtaattatcgggtaacggtttgttgccccacttgtcaattattgcctgtaattggggagaaacaactgcacgtatctctttcctattctttgtcgtgcgctctgttttctgtctcacaaaacatatttcaccgtccacaatatccgagaacttcaatttcagcatgtctgtcggattgataccgttgcacaagtaaatgaatatccagaggtctttatatctgttagtggtttcattttcactcttataatcgaaaatggccttcaactgtttctttgtcaatcctttctttcttccgataccggtctttatctcgaacagaccttttccgaatgggtattgcgattctttgataacgccggctctcttggcttcattcatcaaagtacgaatatttctcatgtgcataccgattgtagaaatacttctcgttttcgaccaaagtctttcgcatttttgtaaccattcaaccgtaacagtactaaatggaatatctttgccgccgacttcctcaaccattaccaatgtagtttgatagaactgcattgtcccgattctttcttcgtttttcagttcctcaatcttagctcgtatggcactgttcagagtatcaccggtagcttttcccaaacgcaaattgagcgtattaaaagagaatgttcctttctctgccaaagcttcaacattcatacggactaaagaaaaactactttcaatggcttgtctgattttcttgctttcagaagatttgctatccgggagtttgttccattcttctttcgtcatgcagataccaatagaataatacttgggctttctttgataataaaccttgattttaataggatatttgccttctttgttggcagtacgtgcatcaagtaccgtagagactacgataccgtcttttgaaaaattatacatggttttagtgattacccgcaagcggaattgcttacgatagtctatatatcctcatttgaatggaaatataaacgttttgaaaccttttgaatattggttttgagtagtttagacattagtttcaaacggtttaaaacgataatagcaaaacatagtatatatattagtctgtaaataagaattatacgcttcgctcatttcaagaacattattgagaagtatcactaaaagtcggaaaaatacagctatcgataaatagataataaaagttaaacattcaaagccattgaatccgattcttcaattttaaagagttcgcattgattttcagattatgtttgaagattccgagcataaaataaacatagaaaatagaataagtgcagcatattaattgaattaaatggtttgccaatcattaacacaccaataattttgaaaagatgtttttcacgaaacaatatatccttttttattgtttatttgaaaaactatatcatgtaattatcaaatttgataatttattctatgatatatattatcataaagaataaaatacttatctttgcagaaagataacgaattgcatgaatatctatacagaagatgaagcactaattgagttattggaagagggttgcaccaatgacaaaagatacaagagacttcctaaggatgtaatcaaaggttatataaaagcatataatcatttaaaagcagccacaagaatagaagatttattcagaatcggaagtctgcattatgaacgattgaaaggtgacttaaaagactttgaatcggttagatgtaccggacgttggagattaatatttcaaagttccacaatagacggttcattgataattactgaaatagaattaatagaaatatccaaccattatggcgactaaaatcaaattaaacgattgcgtaccttgtatagccattcatccgggtgaaatcattaaggatgaattagatgcaagagaaatgaagcaaaaagaattggcttcacttatgagcatgcctacttccgtactcaatgatattataaagggacgtcgtgctgtaactcctgaagttgctgttttgctacaggaaattttaggaatagatgcttcatattggttatcattacaaaatcaatatgatatagaccaagcaaatataaataagaaaatagtagaacgaaaaaagaatattgagatatggaaagtaatttctcaatattgttctgtcaaatatttcgagaaattaaatgttattggaacgaaaatatcagaaaacataaaaataatatattcaattttcggcgtaacttcagttgaagaactaatagcttcgttttcttcagaaaaggaactttcttattttaagaaatctgaatgtttaaagagcgacccaattaacattttctcatggaaacattttgctttctatcaaagttcacaaatgccggatgttgccgattttgatgaaaacagtttagaaagacttgtgcaggaattgaatcaaatgtttgttgtaaacataaacactattgataagacaaaagaaattctgtcacgatatggaattaaatttattatagtgtctaaattcgacaaaacaccgattgatggattttctttttggcaaggaaaaaatccgaccattgtattaacattacgattaaacaaaatcgataattatgctttcgctttattgcatgagatataccatgtttatatgcatcttattaacaatagagaacagaaatacattgccatagaaggagctgaaataaataaatgcgaggaagaagcaaacaaattcgccaagtgctctttaattggtaaagacttatggaatacattcctcaagcaacattccatgatttctccacatgcaatgcaaatgaaaataaaacaatttgctcatcaacataatatcaatgaggctattgttttaggattttatcagcatgatattaatttgtattctattaaaagctcaatatcaagagagataaaatagaatattcaaatacatttagtatatttgcaattaatatgacctcccacgcttcccatttgaatagcgcacccggagaggtcttcgagttttatataagatgacaagcttcctattattgatataacccaatattaccgtacaaatctaattgcacacaatttgcacacatcttaggaaaatagaagaaaacaagaaatattatttgaaaaggaaatattatctttgggcttggaaatcaagatgtatggatatgaaaagatataaaatgcaaatcgctgaaaatcaaatatttgcgactcacaatctggagatccctggttcaagcccaggctggtccacaaacaagaggctcattcttaatagaatagagcctcttttaatttttggactccgctatacaagcccggtatttgtgtaataaaacaaccttcatcatgaaatacggagtatctccaaatacactgctcataactgccggaaccatatggtcattggcaggagtcaatattctgcgtataggcctgacctgctggatagatgacggacattattggctattcaaagtctgcgaagccagcctggtattcctgctattcttcggcatcattttccataggctatacaagaaacatactctccgtatctcacagaagaaagggaagcactgccccttttcctttttcgacgtaaaaggatggattgtcatgataggcatgattgcaatgggaattgtaatacgtacctgccaccttctgcccgactccttcatcgcagtgttctataccggactttctctcgcacttctcggcaccggactacgcttcatctggtattggtggaggaacagataactccggattcaccgattcccatccggcattcatcggtttttctgccggcaatcacccggaaagtatttggcagcatgcaagttagccctatctttggaccatcaatcataaaaccagaaacaatggaagaaaaacaaaaattcccatcccatgcaggctccggcaaagtgctgaccgcctcgctctttatcctttcaggcctattgctattcgcacgcaatatgggtatcatcaccaaagaatggttcaatatgctggttgcctggcactccttatttataatagcaggtatctataccatgatacgcaagcactatctgtcaggaggtgtcctattgctggcgggactctacctcttgggaagcaaactcatgctatcccccggcaatttccaagccatgctgtggcccttggcccttatcctcatcggcattttctttctcagacatcaccataggagaaactggacacaccaaaggacagtgcatcgccgtgccaagatggtacaacggatgatgaacaagagaatgggagagcaagaggaacaacaatgccagtctgacgacggattcctctgctccaacaactccctgagtgccgtacgccacgtcgtactcgacgagcttttcaagggagcgaacatacacacctacttcggcggtactaccatcgacctgcgccacacgaacatagcacccggagaaacctatatagacttggactgcagttggggaggagtggaactgtacatacccgccgactggcaagtacgcatagaatgcagttgcttttgcggcggatgtgaagacaaacgctggcaaggcacacctgccaaacaagaatggtgcgtacttgtgatacgcggaaacatatccttcggaggtcttgaaataaaagattaagcaatggaagcaggtttattgtaggcaccgtctccatgtatagaacgaatgtcatcgtagcatcgccggcattctcttctggctggtagcttcatgatatgcaacataatggtaagaatagccggaatagcatacatcccctttgcccccaccattcctttccgcctcttgttcggtattcttgcctggatcgctatccttttgtggtatcatctgcagattgtggcagacacttaaacagaagatttcaccgcccccggggcagaaaaggccgctcccctgccacaagaagaaagtattgaccggatcacggtaaaagacggctcccgaattcacatcatcaaagtggaagacctattatacatccaggcttgtggggactacacaaccctggtgacacccgacggagagtacatcaaggaacagaccatgaaatacttcgagacccatttgccagcagataactttgtccaaaattatttattcctttactttgctatgatgaaacatctgtattacatacttatgtttactttcctctgtctgggtttgactgccatctcccaggaggaacagccaaactcacggaatactgccgggagtccggcctccgaatgctcttttaccgcctacacacaatgtgcatcgtacacagtcacccaccgttcacttttcaatgacgaaaataccgactgctggaccaacgaagcgttgtgtccgaacagtctatacacacataaccacgcctctccgaaattcttgaagatgagaattctgaaactagccgggcaactggagcatctgctttccagccatctgtctgccggagagagcgccaacctttcattcaatcccagtgccctccgctattcctgcggatactacatctatgcactgctgcatatcctgatttagactttatcggacttattgcaaaccattacgggaggtgtactgcatgtacatctttcgcttttttattatccatttcatcacattaatatcataactatgtccgatttattcctccccacccttgagatgatggggctcacttttgcaatcggtttctttgtggcattcatcatcaaactgatagccagcgcagccgattcactcgatttctacagttcccaccagcaggagttactccgcctgcgccgcataaagaagttccgccagaagatggaactgatactacacaccccctccatgcacggaaacatcttcggcaacgacacgcgcgaagactacagccggggtgtggaccgtgaaaacgaaaagcctcggggctattaccacggagtgagccacggcgtttccaagaaaaacctggtagattacttctacccggaagatacccatataatgtatctggaagatgccatcagccaccgtgacaacaagaacaagactaaaaagaacaacgacaccgaaaacaaagactaatcatggagaatatagattttgcaaccttgttccaaggattcggaacaatgatggaaagcggctggctgctctcctctgcccgtgtatttttaatggccctgggcctgctgctcatttacctgggatggaaaggcgtactggagcccatggtcatgattcccatgggactgggtatggtcgccattaattgcggcacccttttcatgcccaacggtacattggggaatctctttctggacccgatgctttcggatacggacgacttgatgaataccatgcagatagacttcctgcaaccggtctacaccttgaccttcagcaacggattgattgcatgcttcgtatttatgggtatcggcaccctgctcgacgtgggcttcctgctgcagaaaccgtttgccagcatattccttgccctatgtgccgaattgggaactttcttgactgtacccatcgcatctgcattgggactgtccttgaaagaaagcgcttccgtagccatggtaggaggtgcggacgggccgatggtgcttttcacttccctagccctggccaaacatctgtttgtacccatcacggtagtggcctatctctatctgggactgacgtatggcggttacccctatctggtgaagctgctggtgccgaaacgcctgcgcgccatcaagatgacgagcaagaagccgcccaaaaactatgatgccaaagtaaaactggctttctcggctatattgtgtgctgtactgtgttttctgttcccggttgcctcaccgctgttcttctccttattcctcggagtggcagtacgcgaatcggggatgaagcatatctacgattttgtaagtggtccgctgttgtatggttctactttcatgctcggcctgttgttaggcgtactttgcgacgcacatctgctgctcgaccctaaaattcttaaattgttggtattgggtatgggcgcactgctgctctccggtatcggcggaatcattggagggtacatcatgtacttcatcaagcggggcaattacaatccggtcatcggaattgcagccgtgagctgcgtgcctactacggcgaaggttgcccagaagatagtaagcaaggacaaccccaattccttcatcttgggagatgccctgggtgctaatatttcaggagtaatcacttcggccatcattacgggtatctatattactataattccctatctgtagcctgcgtagtgggtttaggtgacggaaagaggttatggcaatcacaatctctttctttttatgatacatggggcaagctgttgcatttcagataaaatcctttacctttgccggcaaacacatttatcaagatatcaggatgaagaaagtacttaaattggccggaggattcatggtcggggcatgcatcggctttgtaggaataataggtgtaagagtcctggtttggggagactcgttcgacggtttacacagcaagtttgccgaaaccggcatgctggagacagtaggagtttccttgttagccatactgattctgctattctccatcttcctgcaagtacttctgcacgaaggcgggcatcttgtctgcggactggcaaccgactaccgcttcgtctccttccgcatcttcaaccttaccttcatacggaaagacgggaaattatgcatcaagcgtttcagccttgccggaacgggaggccaatgcctgcttaccccacccgaaaggactcttgaagatatcccgaccaccttgtacaacctgggtggagtgcttgccaacctgctgaccgccatccttgccttcctccccctgctgaccgtagacgggctgccttacctgctgaaattcttccttctgattctttctctaattggcattctccttgcagggatgaacggcatccccatgaagatgggcggcatcggcaatgatgccgacaacatgcgcctgcttctcaaggacagcaagagcaagcaggcactggtcacccagctgcgcatcaacgcactggtgcaagagggcatgcgtcctaaggacatgcctgccgaatggttcagccaaacggaagacatcaactacaaagatgccctgcaggtcaccatagccttgatgagcgcctcacgcctgctcgactgcgaaaaatgggaagccgcctacaatgcattcgagaaaataatgagtcaccggcacgaagtcatcggacttttgataaaggaaaacgcttgcgagctgctcttcaccgcactggtgacaaagaggaccgcacgggcaaaagaattatataccgatgagctggatacctacatccggcaatacaaggatgtgacctcttccaaacagcggttgctctgcgccctggcgctctaccgggacaaggacacagcaaaggcaaaggagatttacgaagccacctgccaacggaaaaacaaatacctgatgcagggagaagtacattcggacatagccttgatgaaatcaatccttaccgccaagaacgccttgtaagatggaacgatatttcttttactcgttatatctgctgcttggctgctcactatacggttgtagcggaaaacaagcgccaaagcagatacaaaacccgggtacggaagccaccatcccgtacgccgacaccgtagcggcatccgtccctccggctccagccaaaagcctgacagcccgctacctggactccctcggtttcgtcaacatcgccgaagcggacagcagcatcgccatcgacttgatgtacacccgtgccgacaatttcaccggaaccctattgtacgaagacctgaaagaagcctacctgcaccccgatgccatgaaaagcctgaagcaggcacaacgcctgctgaaagagcggcgccccggctacagcctcatcgtctacgacgcagcacgccccttgtccgtacagcagaagatgtgggacgtagtgaaaggaacctccaaatacatctatgtctccaacccctcgcgcggcggtggcctgcacaactacggactggcagtggacatcagcatactcgacgataaaggaacccctctgcccatgggcaccccgatagaccatctgggcaaggaagcccacatcacggaagaagccacgctcgtggcacaaggcaagctgacggaacaagaacgtgaaaaccgcctgctgctccggcaggtaatgaaagaagccggattccgcccgctatccagcgaatggtggcacttcaatcgcgtcggcaggcagacggcgaaggagcgataccgggtcatcccttaactctcacccccagcttgtccgaaaacttaattttgctatcgctttgacgcagatgacacggattttaatcttcttaatctgcgtaatcagcgtcatctgtgtctgaaaaataatcagacagaaagctacgaattcatgccttactttgccctttttgagataactttgcatcagaataaataagccaagccatgcctttatcccaagacaccctccgtttcattcgcgagcatcgtcgcgacgacgtgcgcagccttgctttgcaggcacgccgctacccttcggtagacatgcccgctgccatcacacaaatttccggctggcaggttgccaaagagaaaatacccgcatgggcgaagaacgacgacatcctctaccccgcccacctctcattggagcaatgctcctcccaagcaacggcacagtataaagcggagatcatagctaacctgctatgcacagaacaagagcatcccgcgaaggacagcgcccctgcaccagccgccacttttaccgacctcaccggaggtttcggcatcgactgctccttcctctcctgctgcttcgggcacgccacttacgtagagcgccaggaagccctctgccagatagccgcacacaactttcctgccctcggcctaaatcacatctccgtctgccacgcagacagcgtccgccatctgcaagagatggaacccgtagactgcatattcatagaccctgcccgccgcgacggacacggcggaaagaccatagccatcggcgactgcgaacccgatgtagccaccctggaagacctgctgctccggaaggcacggcacgtactgataaaactctcccccatgctcgacctcacccttgccatgaacgatttgaaacatgtccgccaggcacacatcgtctccgtaggcaacgaatgcaaggagctgctgctcttgctgggacaaggcggaagcctgccaacagacgacgtccccatccattgcgtcaacttcacctccgccccggctccccaaacccttgtcttcacccgcgggcaagagaaagagtgtgcatgcccctacactcctcaactgaaatcgtacctctacgaaccgaatgcctccgtgctgaaagccggagcgttccgcagcctttccttattatataaggttaaaaagctgcatcccaacagccacctctacacttcggacagcctccttcccgacttccccggccgcaagttccgaatctcctcctcctgcggcttcagcaagaaagaaatgaaagagatgttggctgccgagaaaaaggcgaacctcaccgtacgcaactttcccgccaccgttgccgaactgcgcaaacggctgaaactggccgaagggggagactcttatctctttgccactaccctggcagacgaaaagaaggtacttatccgctgccagactaccggataagacaccaaaccctatatctttccttgcacaagatgtacatctcatactgttcgagatgtacatctcatgcagtctgagatgtgcatctcgtgcatccttagcattagtctgccagacgacgacaaaaagagatagcgccgaaagagtactacctccaagagcttatgtaacttcattgtaaccgaatcgttacctgttcttcaactctctgcaaaatccgcgtaacggcaacctcctacttttgcggcagattattaacagataataacaattatgaaacagatcttgagagcattcttattcctgctcttattcaccgccaccggcaatacagccatggccgacgaaaaagcaaatgtcacgaaacaaggaactgtacgcgggcgtatcattgacgccactaaacagactctcccgggcgcttctatctacatcgagaaactacacactggcgtgacgagcgacgtcaacggcttctacactttctctaaccttgacccgggaacctatacagtaaaggtgagctacgtgggctactcgcccgtagaactgaaaatcaccatccccgcaggccgcacactggagaaagacgtcgtgctaaacgaaggtgtggagttgcaggaagtggtggtaggcggcgccttccagggacagcgccgtgccatcaactcacagaaaaacaacatggggattacgaatgtagtctctgccgaccaggtaggcaagttccccgactccaacatcggtgacgcccttaaacgcatctccggcatcaacgtgcagtacgaccaaggcgaggcgcgcttcgggcaagtacggggcacgagtgccgacctcagctccgtcaccatcaacggcaaccgcgttccctctgccgaaggcgatacgcgcaacgtacagctcgacctcattccggcagatatgattcagaccatcgaagtaaacaaggtggtcactgcggacatggacggcgacgccatcggcggcagcatcaacctcgtcaccaagaactccccctacaagcgcaccattgccgccactgccggaaccggctacaactgggtgagcgaaaaggcgcaactgaaccttggcttcacctacggcgaccgcttcttcaacgacaaactcggcttgattgtatcggcctcctatcagaactcaccttccggctcctacgacaccgaattcgtgtgggagcaggacgatgacggcaagacgtacgtcaacgactaccaaatccgccaatactacgtcacccgcgaacgccagagctactctgccgcactggactgggacatcgatgccaaccacaaactgaccttcaaaggcatcttcaacaaccgcaacgactgggagaatcgctaccgcaccacgctgaaagaccttgatgccgacggcaacgccaccgtacgcatacagaccaaagccggtacgccggacaaccgcaacgcccgcctggaacgccagcgcaccatggactttgccctcggcggcgaacacctcttcggctcactctccatggactggcacgccagctatgccaaagccagcgaagaacgtcccaacgaacgctacatcgacttccaactgaagaaacagaagttcgacatggacctgagcgacgaacgcgaaccgtttgccagccccaaagcaggctctaccatgacgctgaacgatgaattcagcctgaaagagttgacggaacagcaggaagacatcaaggagcaggacctgaagttctccgccaacttcaagcttcccttcaagaacggcaacaagctgaagttcggcgcaaaggtggtgcgcaagaccaaggataaagaagtggacttctacgaatactctcctctgaacgaggacgccttcatgacgaacagcctggcaaatacagtggaccaaaccaacaagaacttcatgcccgacaacaaataccaggcaggcatctacgctagcaaggaatacaccggctctttagacttgaacaacgcttccctctttgagaaagagcaggtgcaggaagaacttgccggtaacttcgatgcccgcgaaaccgtgacttccggctacctccgcttcgaccaaaaactgacaaaagacgtggaactgatgaccggactccgcatagagaacaccaaccttgcctatacgggacgcacctacgatgccgacgaagacctcaccagtaagaccgaccgtcagcgcaacagctacatcaacttcctgccgtcgctgctcgccaagtggaatgtaaacgatgacttcaaagtgcgcggttcgtttacccaaaccttgtcacgccccaaatactcggccctcgtgcccagtgtgaatatcaagcgttccgacaacgaaatcaccatcggaaacccggagctgaaacctaccgtctcctacaacttcgacttgagtgccgactattacttccgcagcatcggtctgataagcgccggcatcttctacaagaagatagacgacttcatcgtagaccaggtgagcaccaactacgaataccagggtaacacctacacccgcttcacccaacccaagaatgcgggcaacgccaacctggtaggggtagagttatcctaccagcgcgacttcagcttcattgctcccgctctgaaatgtgtaggtttctacggaacgtacacctacacccactcccgtgtggaagacttcaacttcgaaggccgcgagaatgagaaagacttgagcatgccaggttctccggagcataccgcaaacgcttccctatactttgagaaaggcggcctgaacctgcgtctgagctataacttcgcttccgacttcatcgacgaaatgggagaaagcaccttctacgaccgctactacgacaaagtgaactatatggacgtaaacgcgagctataccttcggaaagaaattcaagactaccttctacgccgaagccaacaacctgctgaaccagccactacgctactaccagggcacgaaagaccgtaccatgcaggcagaatactacggcgtgaaagtgaatgcaggagtgaagattaatttttaatgatgactgattatgaagaaactattccttttattattggttgccctactcggcaacgcggctattgcccaaattaccgattactccatcttcgacaagaagttcaacttctacgtagccaacgacctcggccgcaacggctactacgaccagaaacccattgccgaactgatgggacagatggcagagaacggcgcagaccccgaattcgtacttgccaccggcgatgtacaccattttgaaggtgtacgcagtgtgaacgaccctctttggatgaccaactacgaacttatctacagccatccggagctgatgatagactggttccccctgctgggcaaccacgaataccgcggcaatacgcaagctgtgctcgactacagtaacgtcagccgccgctggacaatgcctgcccgttattataccaagacattcgaggataaaggcgctactatccgcatcctttgggtagacaccgccccgatgattgacaaataccgcaatgaaagcgatacctatcccgatgcctgcaagcaggactaccggaagcaacttgcctgggtggactccgtactgagcgccgccaaggaagactgggttatcgttgccggacaccatcccatctatgccgaaaccccgaaggacgagagcgaacgcgcggatatgcaggcacacctcgatcccattctgcgcaagcacaaggtggatatgtacatctgcgggcacatccacaacttccagcatgtacgcgtggcaggcagcgacatcgactatatcaccaattccgccggttcgctcgcccgcaaggtgaagcccatcgaaggaaccgtattctgcagccccgaaccgggtttctccattgtatcggccagcaaaaagacactggaactgcgcatgattgacaagaaaggaaatgtactgcacacggtgacgcgcagcaaataacctactaaactcttcgcgacagaaaatccggaaatgttgaagaaaatacagtcacactgaagaatacatcgaaaagttttcaaaacaaaacagaaaaggatcttgcaggagataatagatgaactgtaatattatcaccgaatacgaaaaagcttgtacttgcgggataaagggaaatcatgatttccctttatcccgcaagtcatccttgggtatggtcgtctcactgccgtcacgcgtagctatgtagtgaggagacatgatttcgatgcctgcttcgttgaaaacatcctggatattctgatgcaaatcagagtaaatctggctaaggctgttggcatccctgatataggcattcacttgataaaccggataataatcctgaagggaagtttccaatataaacgggcggggatcatctatcactccaggggtattcaatgcagcctctatcaacagctggtgtgtcttccgccacggaacatcgtagccaatactgacctccgaatggataatcaatccatactcacgggcagactggctgtaattgaccgtatgggaagacatgatgaaagagttcggaatggtcaccacctcattcttcggggtacggatgcgggtgacaagcggcgttttctcaatgatgttgcccgtagtgtcgttcagcttgatgcggtcacccagcttgaaaggtcgcatgtaggttatgaccagccctgcaatgatattgccgataactgtactggagccgagcgaaacaatcaagccgacaaacacagagattccctggaagactcccgacttggaacccggcaaataagggtaaatcatggcaatcataaacgcataaagcaagaagcgcacaatgtgataggtaggaatggcccaatccggatagaagccgtttatcttcagccgttcagcctgcacctcattggcaagatagcgcaccagtctgactaaatacttcaccgcatagcatatcacaaagatagtgaacagattgggtatatagtcggttattccattcagaatgacctttataggattccagatgtaggagaataatgtataagccaaactcttggtctgagggaaaatggagaataacagtggaactgtcagcaacaactgcaacagcatgaccacataacgcaccagattggcagcaaacaccagcaggttgacctgcttctgcgtatccaacaattcataatcctgaatggagatcggtttcagtttggtatccttcagtttctggatgcgtagtttgagctttctgaacagccagttagtaaacttgaataggaagaattgtcctacaagcaccaggataaaatacaagatgcgtttacccaactgccacaagctatgctccttctgcatggcttttagtttgtccaccacgacatgcctcttgctggcggccagctggtcgcgagtacagttttcccacaaagcatcctgatcggtaaaggaaatgatgaccttttcgccatacatcaagtccgtaacaatatccgtactctccaaataaacagagtccggacgcagactgaaacgcgtgcccaatgcttcgatgacgctacttacatccttggcccgctgctgaggcgtatgccctccacgcttggcatatagatagaacaaggtgtccttctctaccaccaccggaatacccggcgtcaccgtccgcaacgaatcaatgcgttgtttctgcaatgccagtttcaccgaatcggccgcatagcccgccaacttcatctgctccatttccatccgcaaattcgcctcgttcagccgggctgtttccaactcccgccggacaagcgacaactgaatcgaatcggagtcggtccttgccactgtgacactccccacactatcctcccctaaaacactgagcactttatctaccagctgagctgacactccgcccgccagcatcaacagccaactaagacagaaagtacggataaccttcatatataaacttcttgatttgattctttaattatgcaagcatacccaataaatgctccaaacatacagaatgtttttaacttcctatcctaatcaacataactttttcatgcaaacatgaaaattctatatccagtttgcattatctttgtactcaaaattgacatacttatggatatattgtttcttgtcggaggactgctcctcattcttttgggtgccaatggcttgacagatggtgccgcatccgttgccaaacgtttccatataccgtccatcgtcatcgggctcaccattgttgccttcggtacttccgcaccggaactcaccgtcagcatctcctctgctctcaaaggcagtgcagacattgccattggtaatgtggtgggaagcaatacgttcaataccctgatgattgtgggttgtacagccctttttgccccgatagccatcacccgcaatacactgaaacgcgaaatacccctttgcatcctttcatccttcgtcctgctgatttgtgccaacgatgtctttctggacggcggtggggagaacatactcagcatcaccgacggcctattgctgctatgcttctttgccattttcctgagttatacttttgccatcgcaaaaagggatggaagtatgaaggaaccggaaaaagagcacttgcaggaagaagacgaaatcagactgttacccgcgtggaagtctaccctatacattctcggcggacttaccggcctcatcatcggaggtaatttctttgtagacggcgccagcggcatagcccgcggattgggtgtcagcgaatccatcatcggccttacgctcgtagcaggcggcacatcactgcccgaacttgccacctccatcgtagccgccttgaagaaaaaccccgaaatagccatcggaaacgtcatcggaagcaatctcttcaatatattctttgtgctgggttgttcggcctccatcactccactgcgtctgacgggcatcaccaatttcgatttgtgggtacttgttggggccagcctcctgctttggctgttcggtgtctttttcgggaaacgcatcatcacccggctggaagggagcattctgattctctgctacattgcctacacagcggtactgatatacaacctctaacagcaaatttacagacactctacgcggtattttaaagattatcacgtatctttaaataaggcaagctgcatctcggcataaaaaataagcaagcttattttgttctactctcagtttgcattacctttgccacctcaatattgaacaactatggcaattacaatcaagaaagtaaccacaagacgggaattgaaacgctttatccgtttcaactacctgctatacaaaaacaacccttattccgtccccgaccttttcgatgacatgctcaacaccttcaacaagaagaaaaacgctgcatttgaattttgtgaagccgactatttcctggcttatcgggaaggtaaaatcgtaggacgtgtagctgccatcatcaaccacaaggcaaaccaaacctggaacaaaaaggaagtccgcttcggctggatagacttcatcgacgatgcggaagtctccgatgccctgattcgcaccgtggaagaatggggaaaagaacggggaatgacacatatacaaggcccgctgggattcacagacttcgatgccgaaggtatgcttatcgaaggattcgaccagctcagcaccatggccaccatttataactatccctactatccgcaacatatggagcgcatgggatttgagaaggatgccgattgggtggagtacaaaatctacattccggatgccatacccgacaagcacaagcgcatctccgacctcatccagcgcaagtataacctcaagataaagaaatacacatcggccaagaagattgcccaagactacggtcaggccatcttcgaactgatgaacgaagcctatcagcccctctacggttattctgcactgagccaacggcagattgaccaatacgtcaagatgtacctgcccatcctcgaccttcgcatggtgacactgattaccgatgccgatgaccagctgcttgccgtaggcatttctatgccatccctcgccgaagcgttgcaaaaagcccacgggcgcctgcttcctatgggttggtatcacctggccaagaccatcttcttgaagaaatatcccaaaatgctcgacttgctgctggttgccgtaaaaccggaatatcagaacaagggcgtcaatgcactgctgttctccgaccttatccccgtctatcagcaacttggtttcgagtatgccgaaagtaatccggagctggaattgaacggcaaagtacaagcgcaatgggagtacttcaagacggaacagcacaaacggagaagatgctttgtgaagggaataaaataaattctaaatccagaatataagcttgtcagaagtccataaaagacattatttttttgcgaacccccgaatttctcattacctttgtcgcaatgcgcaatatgaaggaataacgtacttatggaagataacaacaatatgaccctgccgctggaagaagcagacaacaatatcacagagagccccgtttccagcgtagaatataccgacgacaacatccgccacctggacgacatggagcatatccgtgtccgttccggtatgtacataggccgtctgggcgacggctcacagaacgacgacggtatctatgtgttgctgaaagaagtgatggacaacagcatcgacgagttcaagatgggtgccggaaagcgtatagaagtgactatagaagacggcctgcgcgtcagcgtgcgcgactatggacgaggcatcccgcaaggcaaactggtagaggcagtcagcaaactgaataccgggggtaaatatgactcgaaggctttcaagaaaagtgtcggactgaatggcgtgggcatcaaggcggtcaatgcgctgagtagccgtttcgaggtacgcagctaccgcgacgacaaagtacgtaccgtcatcttcgagaaaggaacgctgttgagtgatgtgaccgaagactcgacagaagaaaacggaacttatatcttctttgaaccggacaacacgctcttctacaactattccttccagaaccagttcgtagaaaccctgctgcgcaactacacctacctgaatacgggcctcaccttcatttacaacggacagcgcatcgtctcccgccacgggctggaggacttgctgaaagacaacatgaccagcgaaggcctttacgacatcatccacttgaaaggagaggacatcgagattgccttcacacataccaatcaatacggtgaagagtactactcctttgtcaacgggcagcacaccacccaaggcggtacacaccagactgccttaaaggaacacattgcccgtaccatcaaggaattctacaacaagaaccaggagtatgccgacatacgcaacggactggtagccgccatcgccatcgacgtggaagaacccatgttcgaaagccagaccaaaacgaaactgggcagcaacaacatgtggcctgccgcgccgcaggagcacaagcccgccggccccacagtaaacaaatacgtaggagacttcatcaagacggaagtggacaattacctccacaagaacccgcttgtggccgaagtgatgctgcaaaagatacaggactccgagaaagagcgcaaagccattgccggcgtcaacaagctggtacgcgagcgcgccaagaaagccaacctgcacaaccgcaagctgcgcgactgccgttaccacttgagtgacggtaaaggcaaggatcaggaaaccgaatcctgtatcttcattaccgagggagactctgccagcggctccatcaccaagagccgtgacgtgaatacccaagcagtattcagcctgcgtggtaaaccgctaaatacctacggactgaccaagaaagtagtttatgaaaacgaagaattcaacctgctccaagcagccttgaatatagaagacggcatagaaacactgcgctacaacaaagtcatcgtagccaccgatgccgatgtggacggcatgcatatccgcctgctgattatcaccttcttcctgcagttcttccccgacctgataaagaagggacatgtatacatcctgcaaactccgctcttccgcgtgcgcaacaagaagaagacaagctattgctacactgaggaggaacgtgtgaaagccattgaagaactgggtcccaaccccgaaatcacccgattcaaaggtctgggagaaatctcgccagacgagttcaagcatttcatcggcaaggacatgcgtctggagcaagtgtcgctgcgcaagacagacctcgtaaaggaactgctggaattctacatgggtaagaataccatggaacggcaaaactttattatcaacaacttggttatagaagaagacttggcatcatgagaagagctatctttccgggaacattcgacccatttactatcggacactcctcggtagtgagccgtgcactaactttcatcgacgaaatcgttataggaatcggcatcaatgaaaacaagaacacgtatttccccctggaaaagcgcgaacagatgatacgggactactaccggaatgagccgcgcatcattgtgcagtcatacgattgcctgaccatcgactttgcccggcaggtagatgccagcctaattatacgcggcatacgcaccgtcaaggatttcgaatatgaggaaaccattgccgacatcaaccgcaaactgaccggcatagaaaccatcctgctcttcaccgagccggaacttacctgcgtcagctccaccactgtgcgcgaactactgcaatacggcaaggacatcagcatgttcataccggaaggaatggagattagggattaaggattaggaattaaaatggagatgatgaagaaactatttactattataatatgtatatgcgcgatgacggcgcaagcgcaaaagccgaataatgaagccctgcgcaaactacagatggcagagtttgccatcaccaacctctatgtggacaaggtggatgaagacaagctggtggaagaagccatcatcaagatgctggcacaactcgacccgcactccacctacaacaatgccgaagaagtaaagaaaatgaacgagccgttacaaggcaatttcgagggcatcggtgtacaatttcagatgatagaagataccctgcttgtgatacaacccgtcagcaacggtccttccgagaaagtgggtatccttgccggtgaccgtatcgtagccgtcaacgacagtgccattgccggagtaaaaatgagcacggaagatattatgagccgcctgcgcggaccgaaagactcggaagtgaaactgaccatcgtacgccgtggcgtggaagaccagctgtacttcaacgtaaaacgtgacaaaattcccatcctcagtctggatgcctcttacatgatacaacccaaaattggctatatacgcatcaaccgctttggagcaaccactgctgaagaatttgcagaagccctgaaaagcctgcagaaaaaggggatgaaagacctaatcctcgacctgcaaggaaacggaggagggtatctgaatgccgccatcgaccttgccaacgagtttctcaagcaaaaagaactcattgtctacaccgaaggaagggcttcgcgccgcagtgatttctttgccaaaggtacgggcaacttcaagaacggacgcctcatcgtattggtggacgagtactccgcttctgccagcgaaatcgtgaccggggccattcaggactgggacagaggtgtgatagtagggcgccgcacattcggtaagggactggtacagcgtcctatcgacctgccggacggttccatgattcgtctgaccatagcccgttactataccccttcggggcgttgcatccagaagccttacgacagtaccgccaacctcgatggtcgtctgagtggagaaaacagtcaggataaatataatcaggaactgatagaccgcttcaatcatggagaaatgattcatgcggacagtatccattttgccgactccctgaaagtgcagaccaaacgtatggggcgtaccgtttacggaggtggaggtatcatgcccgactttttcgtccccatcgacactacccagtacacagactatcaccgcaatctcgtagccaaaggcgtggttatcaaagccactaccggctacatcgagaaacaccggaaggagctgcagaacaaatacaagaaatttgaagccttcaacgagaaattcgagatagacgataacttccttgccgaaatacgtgcgcttgccgacaaggagaaaatcaagtttgacgagaaacagtaccaccaatccctaccgctcatcaagacacaactcaaagccttgattgcccgtgacctatgggacatgaacgaatacttccaggtgatgaacaatacgaaccagagcgtacagcaagctctaaaagtgttgaatgacgacatttacagtaccattattcaatagccggcttaaaaccgacattaggcgcggattatgcggaatacgtaaactaaatccgcgtaatccgcgcctaaaattattctccaaacagccatttattcaaccacttgttgacatagatattgaccacagcacatcctgcaccgattgcagcccccgccaatacatccgacggataatgcactccctcgttcatacgggaaactcccacggaacaagcccacaaggcagacggagctatcacataccatttaggatacttcacactgagcgaggtggcaagggcaaaagccgttgccgtatgcccggaaggaaaagacgggctgccttcatgactatatgcatgtactctgtcgggatatttatcataaggacgttcacgacccaccagatacttcattccataagtcacaacaaaagcccccgccacacttgtacctacgtagaccgcatctttcagcaaacccttatcatgttttatccaagcggcaacggccatcgccaccggaacaccgacagcaatatagggctccgaacgtgaaattatcttattatagttacggacaaacttgccatcccaactgttaacccggtgcaaagtgttgatatcccaattctgtgccgaaagaccggatacaacaaggcagataaaatatacaaaaaaaacagcctttttcataagtcctttatactagtttgacgcaaagataggacaaatagatagagttttcacaaaaaaattctatctttgttgccacatttataataatttgctaatcatttcatgagactggaaacttactgcaaccgacagattgattgtgtggtatgtcctcaaaaatcagaagaagtattggtttaccgccactatcccaagggacaacatttctctgctgaaaagtgcacacagaactgcatgatatttatgctgaaaggcgaattacttgtaaacagtaacgaatatccgggcaccactctccaaagtcgccagctcattctgcaagccatcggctccaaagtagagctcttggctctaactgaagtggaatatattgtctattggttcaccgagctccccctgatttgcgaagaacgttacaaggagatactgaaacgctcggaagcccctctgatttacaccccgcttacagcaattcccatgctcgaaggacttctgaaaagccttgcctgctacctcaacgagcagccttatgcgtgcagcaaatacattgaaatgaaatgccaggaactgacatacatattaacatgctactatccactacaccaaatcagtacatttttctaccccatcagtacttatacggaaagcttccagtatttcgtcatgcagaactacgacaaagtgaagaatgtggaggagtttgcccacctcggcggatataccaccaccacattccgccgtatgtttaaaaacatgtatggggtcccggtatatgagtggattctggacaagaaacgcgaaggaattctgaacgacctgcaatataccaaacaacgcatttcagtcatcagcgcccgctatggctttgattccctatcccactttgcccacttctgcaaagactctttcggagacacaccccgcgccctgagaaaacgtttggcaaacggagaaaagatttccattatctgcaaagagcaaggcaaagaccaggaggacgagtaaaccttttacttgtccgcaaacttcgcatcctgccggattacggaattatttctttaatcgcttgctttatcgctggatttctcctatttttgcgaaacatttacagaagtatcctgatagaacaaattttcaaactattaaataacttaaattcaatcatttatgtggttaagtaattcatctgtaggaaggaaagtggtgatgagcgttaccggtatcgcccttgtcctgtttctgacatttcacatggcgatgaacctggttgcattagtctcggctaatggctacaacatggtttgtgagttcttgggagcaaactggtacgcattggtggctacggtaggtctggctgccttattcatcatccacatcatctacgctttctggttgactatgcagaaccgtaaggcacgtggtagcgaacgctatgccgttacggaaaagcccaagactgtggaatgggcttctcaaaacatgctcgtattgggtatcatcgtaatcgtaggtttgggcctgcacctcgtaaacttttgggctaaaatgcagcttcccgagttgatgcacaacatgggcatgcatgccgacaccctcacgctggcatatgcagccaacggtgtctatcacattcagaacaccttcagcaatccggtattcgtagtgctttaccttgtttggctgggcgcattgtggttccacctcactcacggtttctggagctccatgcagtctttgggctggaacaacaaagtatggattaaccgttggaaatgtatctccaacatctattctactatcgttgtcctctgcttcgctctggtagttgtcgtattctttgcaaaatcattgtgcggcgcttgctaaattcaaattgtaaatgactaaattgtaaattgcattatgactaagatagattctaaaataccggaaggaccggtggctgagaaatggaccaattataaggctcaccaaaaattagtaaaccctgccaacaaacgtcgtctggacatcatcgtagtaggaaccggacttgccggtgccagtgctgccgcctctctgggcgaaatgggtttcagagtattcaacttctgtatccaggactctccgcgccgtgcacactccatcgctgcacaaggtggtatcaatgctgctaagaattaccaaaacgacggtgactctgtgtaccgtctgttctacgatacagtaaaaggtggcgactaccgtgcccgcgaagccaacgtttaccgtctggctgaagtatccaacaatattatcgaccaatgcgttgcacaaggtgttcctttcgcccgcgaatacggtggtacactggacaaccgttctttcggtggtgcccaagtatcacgtactttctacgctaaaggtcagaccggacagcagctgttgctgggtgcatactctgcattgagccgccaggtgaacgtaggtaccgtaaaactgtacacccgctacgaaatggaagatgttgtcctcattgacggacgtgcccgcggtatcattgcaaagaacctcgttaccggtaaattggaacgttttgccgcccacgctgtggtaatcgctaccggtggttacggcaatacctacttcctttctaccaatgcaatggcatgtaactgctctgctgcaatggcttgctaccgtaaaggtgcctggtttgccaaccctgcttacgtacagattcaccccacttgtattccggttcacggtgacaagcagtccaaactgactttgatgtccgaatctctgcgtaacgatgggcgtatctgggttccgaagaagctggaagatgccaagaaactgcaggaaggtacactgcaaggaaaagatattcccgaggaagaccgcgactactacctggaacgccgttatccggcattcggtaacctcgttccgcgtgacgttgccagccgcgctgccaaagaacgctgcgacaagggcttcggcgtgaacaacaccggtcttgccgtattccttgacttctccgaagctatcaaccgcctgggtaaagatgtcgttgcacaacgttacggcaacctcttcgatatgtatgaagaaatcactgatgtcagcccatacgaaaacccgatgatgatttatccggctatccactataccatgggtggtatctgggttgactacgaactgatgacctccatcaagggactgttcgccatcggtgaatgtaacttctccgaccacggtgcaaaccgcctcggtgcttccgccctgatgcaaggtctggccgatggttacttcgtattgccttacactatccagaactatctggccgaccagattacagttccccgtttctctaccgacctgcccgaatttgcagctgcagaaaaggccgttcaggagaagattgactggatgatgaacatcaagggtaagaagtctgtagactctatccacaaggaactgggccacattatgtgggaatatgtaggtatgggacgtacggccgaaggcttgaaggaaggtctgaagaagctgaaagaagtccgcaaggagttcgagaaagaactgttcatcccgggcgacaaggaaggtatgaatgtagaactcgacaaggctatccgtctgtacgacttcatcactatgggcgagctggttgcttacgatgcactgaaccgtaacgaaagctgcggtggtcacttccgtgaagaatatcagactgaagaaggcgaagccaagcgtgacgatgaaaactacttctacgtggcttgctgggaatatcagggttctgacgaaaaggaaccggtattgctgaaagagccgctggtttacgaagcaatcaaggtacagactcgtaactacaagagctaatcgggaagttgaacatttaaagaattaaagaaaatggataaaaatatatcatttacgctcaaggtatggcgccagaagggtccgaaagcaaaaggcgcttttgaaacataccaaatgaaagatatcccgggcgatacttcattcctcgaaatgctggatatcctgaacgaacagctgatttctgaaggtaaagaaccggttgtattcgaccacgactgccgcgaaggtatctgcggtatgtgttcgctctacatcaacggacacccccacggtcctgcaaccggcgctacgacttgccagatttatatgcgtcgtttcaacgacggcgataccatcactgttgaaccgtggcgctctgccggtttcccggttatcaaggacttgatggtcgaccgtacggcctacgacaagattatgcaggcaggcggctacgtcagcgtacgtaccggtgctccccaggatgccaacgctatcctgattccgaagcccatcgctgacgaggctatggatgctgccagctgtatcggttgtggtgcttgtgtggctgcttgtaagaacggttctgctatgctgttcgtttctgccaaagtgagccagctgaacctgttgccccaaggcaaaccggaagcattgcgccgtgccaaggctatgttgagcaagatggacgaactcggtttcggtaactgtaccaatacccgtgcgtgcgaagctgaatgcccgaagaatgtttccatcagcaacattgctcgtttgaaccgcgactttatcattgcgaaactgaaagactaatccggtctttctgcaaataatataggatgcgcttcggataaaccttttgagcaagctcagatttatcactcagctttcactatatttgattaatatcacaagagactcctctgccgggaaaccgccggaggagtttttttatgacatgccgcttacttcagataaattgccggcacgcaagctacggggagaagccccgaaattctttttgcagaaattggaaaaatgaggcagcgattcaaagccatatttatagcaaatctctgatatggaagcatccgtataacgaagttcataaaccacactttccttcctccgttccatcatccactcgtacaccggttgatgaaaaacagaattgaatatacgccggaaagtagccactgtatatcctcccagctgggcaaattcctctactgtcttgactttggcatgattctgcaagacaaagtaatggaaggaattagtatactgggcaagaggatgtatcagcatggaaagctcatagtcggagtaataatttccaagaatgaaagcaagttctttccgtttgaaacaaagcatttcccggcaaattttctcctcggacaaataggccttggaactttccagaaagagctgcaattcgggagtaatggtcaaaggacagaatatcaatggaggggtaatctctttcatgatatggttataccggtcctcacagaagaattcaggcttactgaaccggtaacaaacacattccacatccgtcatggcaagtatttcgtactttgaaccaatggcttgaaggatgaactcacctgcatgcaacacagttcccgcatactccttactgttaacaagcacttctccttgcagcagaaaaattacaatattttcctcacacttccgtgccggcagatggaatcctctggggtgagaagcatatattattgcattgtccacagccttgggacattgagcgcattgttttttacctccgcaagcagaagagttgggcatcggcaagtagatttgtttgtttgttgcagtgacaaaaatagataaataatactcataaaagaaacattccccgaaaactttcataaagaagtctcggggaatgaataaaatagaagcaattcagttttgcggacagtacccgtttctatttacacaaaattatggatactgccttttatttttccacattcgtatcatcagccgtactccacggaccaacttcaggtacaaaggttacttttgccgccttattggccagcgtcagcgtataacgtatctttttgccttcaccccaggcttgtgtaccatccaagtcaatggcggaagttacagtatcaagaagaacgtctttctcatagatgtcatagacaacattgattttggcgttcgtatccaacgtctggggcatcaacatccaggctgtattcacttccacacccgttgtattcacttccaatgcaccaccgtcaatcgtatgtgcataagtagccgttccttcctgtgacttccatgttgaatcatcaaaaccataagttcccttattgtgcacaccggatattgtaagtgttttcagtttataagtcaaagcgtcggctgccttgacagtgaaatttatttgcgtcagtatatggccgaatttcaaagataccccactggcatttgatgccttggttgcatccgtcgctttcgcggctaccaagtccgtttgggtaactacatccgctaccgtataagtaatggaaggatatatagcaccagcagccggttgattgtacgtcaaggccccggtacccggatccccgtaagcaaagaactgcaagttatccgtcattggccaataatatgttcccccagtcaaactccagtcgggagcactataagttaccttaacatctgccatgaattccttcattgcatcaaaagtcgcaacagaggccattgttgttgctcccgtattataagcatacacagtgaaccctaccttctgcaattccggcaaatcagtcactgcggctctcgtagtgttacccactactgttcccaatttaatctccgccttttgtccggcattctctatctcctcactttccgagcaactcattactgctgctgcagccaaagccaaaaataaaaccttcttcataattgtctgttattaaagttaatatatttatttgtctgtttgctatcaattcaccggtagctccacatccgtctcatcatcccaatcatccacatcgccaccaatccctccatctccttcatcggttcccggttccaaatcatccaccacaaccttgtcctccggtacgggaacctcgatatggatttccgacccaggaacgcccacatcaggttcttcttcgcctcctcccgagggaggagctgtttcaatcacttccgtgatatccaccttcacctcttgaaccgttttatctcgtttcacaatcttcaatgtcagcaacataggactatccgcacgggtcttggcatctttcagtaatacaaaactggagaaatacccccataaaagcccgttttcacgctttgtattcacacatataggtacctcgctcaaatggcaagcacggttgcctataaagtaacttccgttcaagccgtccacatggcagatgatgctcaatattctatcccatccttccacctttatatcaaaggaataatggtccactaccgcttccggcttccagtccaacggaagcgccacatcactctgccttatttccacctcgtccaaagccaccacatacaaagggtcgggcgaccaaaccatatcttcgtgtatatccagccccgtacagtgtcccgtaaaagcctcaatcgtctcataactctcgtcgccccgtatctgtatactctccgtattgaagttataggccaccaccgcatacctccccggcggtaccttcacctcacccccttcggcaggcagataactttcaacctttctcctctgagtatctttcggatagaagataatccgcatggtctgcggcagcttatccgtcacccctttccaatccaatttaatctgtactccgctaacgggataatcatccagcatatcgcggaagtcacagcttcccagcattggcaacagtccgaagaacagccagagaatcatatgccgtgcatctttcataccactcatctccccgacgttagaagccacaccaaagaaacttttgcttttgtcggcccgataaagtgatactttccactgctgacccaaaccaagtcatttccataagaagtatatttcctgtactccgtatccaagtatccaatgcccacactgaattcaatcgccagatgccgagccagtggacgcacgtatccataagttattcctgcagctgcgtaatacttcccccggtatcccttctcctctttcaactgaaaatcataggtacctccttcggcatatgctcccaggaaatgtccgaacaatattccatgcgtatagcggtttcccaaccagtaacgtacctctgtccctcccgaaaggaactgataacagaaaccacatccgctgtcagaccaccaagggcatttgtactcaacattcaaagaccacctctttctcaatggcagctccacttctatgttcggagccaaggccaggtcgtaaagcaaattattttttaacgccagcaccgttttacaagtatggctatgagattccgccgacttattctgccctattacctgccccgacatcatgcaaaaaaggagtagccaaagaacatatataagaatgcgttttcccataatttcgcgttgtatacaaacaaaagtagaagataattaccgaataaaatccactttccatcactcttttcaaaggctgaaaggttctgtgaaacgattgaaacagatttgcaacttttgccttatccgggacgctgtgaatagattctttccatactctctcaaaaagtcaatccgtgtgcgaaaacagtaaaattcagtgaaagaaatacaaaagaagtagcagaatcattctgaaatttggaagataacaatggaaaccttacatttgcaatgtgatttttttcatagtattagatttaaggttaacaaaggttggagtacggcggtactcctttttttatacccatacgtttctccgaatgacaaaaaatagctatcttcgatggcttttataactgttaaagaagaaaacatcaccacttgagcccattatgaaaaaaccggtactcgcattgctttccataatcctacttaccgcaggatgttcccaacggcctgccaccaccaagatacccctgaccagcgcacaccgtggtgcggccaccattgctcccgaaaacacaatggcatccgtagattcgtgcatcaaatacggtgtaggcaatatagaatgcgatgtctgcatcagtaaggacagtgtcttctacgtactgcacgattccaccctcgaccgtaccaccaacggtaccggcgccatctcccaatggctgtccgccgacatcgacacactggatgccggctcttggtttgcgccccgatttgccggacaacgggtactacgccttaccgacctgctacgcaaggccaaagagcacggtttaagaatcaccatcgactaccgcaacggcggtctgcaccaattactgaatctgataaaggacgaaggcatgctggaaaacagcaacttcaccttcagcaaggagtatcatgccaaatgcttcagaaaaatggcacccgaggtaagaaccctgcaagcctacatcaaaagtgaaaaggacatagagcatgtcgtaaaggaactgcatcccgacatcgctgtcgtctggattgactcccttaccccgcaattcgtaaagaaatgccgtgagcacaacctgcaggtactggcacttgtcctggggctggacgacaagacggaagagaaccagaaggcggtcgacctgggggtagacatcatagcgacggaccatccggaaaagttcatcatgaaatacgggcaaccgtccatataaggcaagagacctgccgcgctcaggtcagcaaatgatagacaccgcccaccattgccttgaccactcctttcatctccaattcaaaaagcaaggcactcatccggttgacgggtatatccgcttccaccaccatcgcattgatatggaggtctccttgccgcataaggatgcgtacaacaagctcctcctcttccgtcagttccgggaagagattacgctgaataccttctgtccgggcaggctgctccgctacggaccagcccataatctgcacaaactcttccgcattctggataagggcagccttgttgtcgcgtatcaaccggttgcaaccgatggaagattcgtccgtaacacgtcccggaacagcaaaacagtcacgatgatatccctccgccaactctgcagtgataagggaacctccctttgcggcagactccaccacaatggtagcatcactcatacccgccacaatacggttgcggctgacgaaattatgcttgtccggattcgtcccggtaaggaattcggtcagcagtccgccttgtgccagcatgtcgatggctgttttccggtggacatacggatagatgcggtccagtccgtgagcaaggacagcaacggtagggagatgatttgccaaagcggcccgatgggcatggatatctatcccgtaggccagtccgcttactaccagcacatcgggacaaagaacggccaaatcgcgcaggaagtcgatacagaattgcttgccgtaatcggtggcacgacgtgtacctaccatatcgatgacatgcaggcggttgaaatcggtgtttcctttaaagaaaagtacaatcggcgcatcttcacattcacgcaagcgcgaagggtaagcctcatccttcaacgtcaggcaggaaagacgattcttctctacaaactccatctcctgctcggcacgcagaaaggcagcgggacaatcaagagccgtcactacccccggattcacaccgggcatgatttcgggaagctccttccgccgactgaatacttcggcagcactgcccataccctctattaaacgctttgccccgatatgtcctataccggggcaaagtgtgagagctatactgcaaatccgttcgtcactgttcattccaccaaaaattacacggacttacacgggttgagataaggggcaaaaaggcggtcgaacagttcgctgtcgctcaaccggccattgactacacacacggtctctaccacgcctttgaggcagaccttaccgtcggaaacacggaagatatcttgatagaagacgtacttgataccttccttcttcatataaagtttggaaacaaactcgtcaccactcctcaggggagtcttgaaagccatattgatacgtgccactaccgggtctaccccctgctcgtgcagtccggcaaagctgacgccggcactcaacagaaactcatggcgcgtatgctccagataatgctgataattggcattattgacgatgccttgcaggtcgcattcatagtcgcgcaccttcatgggaagttcatagatataattcatatttagtattggactatttactatttgatacttagccacgttgtttctccacatccaagcctttgaacttcttcagttcctctacgctgaccagcttgtagagtttgtcactgggacgtattttcaccgatttcatcgagaaatgctggcctttctttacagtctgcacgggtttcaaatcgacgcgtgcctcgtccaaagtgacgaattcggcacccgttgtgggacccgtaatcagcaacttgtcgcctacgctcacttcggctgcttctaccaggaactccgccacaccgatgtttgagaagtagcggatgcccttacccacatagattttacgttccgtagcggcagagccgtagttcttggtccattcgcccaagcgttgtcccaggtagtagccgtcccagaaaccacgattgaagaccgtcttcaaacgttcatcccaccgggcaatcttctcatcggtgaatgtatcgtccagataggaacggatggcttctttgtaacactccactaccgtgcgcacgtactcgggtccgcgggcacgtccttcaattttgaaaacacgaacacctgcatccagcatcttgttcatgaagtggatagtttttaagtctttgggggacatgatgtactggttgtccacctccaattccacatccgtctccttgtcgcgcaccgtgtagctgcggcggcatacctgcatgcaggcaccgcggttggcggagtggttcatttcatgcaatgagagataacactttccgctgactgccatgcaaagggcaccgtggcagaacatctctatacgtatctgctctccgctgggaccgcagatattctcctcacggatatgtcggtagatttctgccacctgctccagattcagctcacgcgccagcaccaccacatcggcaaactgcgcatagaagcgcagggcttccacattgctgatgttgagctgtgtgctgaggtgtacctcctgccctatctgacgggcatagctcatcactgccacatcggcggcaatgacagccgagatacctgccgcctttgccgcatctacaatggtacgcatcagcggaatgtcatggtcgtatatgatggtattgacggtaagatagcttttcataccatgttcatcgcacatccgggctatctcccgcaaatcgtcgatagtgaaggtattggccgaacgggcacgcatgttcaggttctcgataccgaaatagatggagtcggcatctgcttgtatggctgctgcgagagattcgcgcgagcctaccggtgccatgatttcgaagtcactgattgagtgtttcatcatttctttttgaattagagtatgcaaaggtaggcttttttctgtacttttgcggacaaatccgcttagattatgaagattaaagatatagacctgggcccacgccccgtattcctcgccccgatggaggacgtcaccgaccctgctttccgcctgatgtgcaagcacttcggagcagacatggtatataccgagttcgtttctgccgatgccttgatacgctccgtaggcaagacccagcagaaactgaatatcagtgatgaagagcggcccgtagccatacagatatacggacgggacaccgtcaccatggtagaagccgcccgcatcgtggagcaggcacacccggacacgctggacatcaacttcggctgccccgtgaagcgcgttgccggcaagggtgccggtgccggtatgctacagaacattccgctgatgctggaaatcactcgtgccgtggtagatgccgtgaagattcccgtcaccgtgaagacccgcctgggctgggatgccaacagtaaaatcatcgtagaccttgccgagcagttgcaggactgcggcattgccgccctcaccatccacggccgtacccgcgcccaaatgtataccggtgaggcggactggacacttatcggcgaggtgaaaaataacccacgcatgcacattcccatcatcggcaacggtgatatcaccactccccaacgggccaaagaatgcttcgacctctacggtgtggacgccatcatgataggccgtgccagcttcggccgcccgtggttctttaaggaagtgaagcattatttggagacgggcgaagaactccctccgctgagttccgaatggcggctgaacgtactccgccaggaagtggaagacagcgtcaacctgctggatgaacgacggggcatactgcacgtgcgccgccacctggcagcaagcccgctcttcaaagggattcccaatttccgcgacacccggatagccatgctgcggacagagacgaaggaggaactgtaccgcatcttcgaagagatagaaccgttgctgccataggagaaaaccgcatacgatttttaccatcgagtccgatacttgagcaatcatcctcacgccccttcttgaatagcttctgagaggggggggagtattcagacacagatgacacgctttgttgccatccgcataactcactgtctgtcagcaagaaattttgccaaccacttgccttgcccttggcaaacttttgccatgcctatggcaaagccttgccaatgggaaggcaaaaccttgccaacaaggaggcaagaaaaaaaacattgtttctttggcagaaagaaacaagtccctatattcgtcttcccaagaaagaatcccataaatatgtctttatgaaaaagaaaaaactactcaaacagctcatcgtaaacttccagcattcacttccggcagaagtttatccgcgtacattggtattgcccacagacagtggaaagataatcaccgtgcccgactagcggaacatcggctgcgcaaaccatcgcttgaacatccacgtggccaggatataaatgccgaaagccgatacgaaacccacgatagagtctatcaggtaatgtgcctggatatagaccgtagccccacacaacagcagatagaaaggaaacaagcaggcaaacagacgcttgctgccacgccatgccataatcatcagtaccgtagacattccgacgtgcgaactgggaaaagcagccgtggggcgctcacccacctgctgggaactctccaccaggttgtagaagaagccgtgctcatagcccggaccgggaagaagttcctgatggtgatggaaatagtcaccgatggacgggaagataccttgcgccacatggtcgcttccaatggcggggaagtagaactgcggcccggcaacggggacgaagatataaataaggtaatagatgaagaaagcggtgacgatgacgaacgaaaccttctcgaaaaggtcgaaacgataaaggaaataccacaccaccaccagcagaatcatcggataatagaagaagtatcccatattgaacggctcgctcacccacatctgcggaaacctttcacagaaccatacagcaggctgtccgccaaacatccactgctccaccgacgcgaacacgtggtcgagattggggaatatccggttgaactcaaaggtgtcgggataccaataggaaagcagtgacatctggatggctatgcgcacaaaggcagagaacttgcagggtgccagccggtaaagatacatcagcaggaacgtcatacccgcaatgacaacacggtctgcaagcatctgcaccggatgatccatttcctgaaaaagaaacagaatgagaatggaagtcagcaaattgtatatcagcgtaatcttctctaccgcaaaaagccccttacgggtttctacccttttaaataaatctaaagccatcccttatccttataccaggcaatggtttcctttacaccccgttccaggtcgtactcaggactgaagcccagttcctcgacggccggtgtgatgtcacactgccagttgcgttgtttcattattctatacttgtccgaattgagcgtactggtcttgttctgccgcttcgcccaaaattcagcgagcaaagatacgactttcaatacaattaacggacatctcaggcgaataacaaacgggttgcccaattctttccttatcaaatcggaaaaagcacggctactatacaccttcccgtcagccagaaaataggcgcggcgggacacctgcttctctatcccgaggaagacggcctgcacgatgtcctttacatatacaaacgtcaagtcctggcggcggaagcccacagaaaagtccgtatgctgccggatggactttgccataagataataatccttctcacgcggcccgtatacacccgtcggccggtagatgacgtaggggaaacccggaatactctgcaaataaagttctgttttcagtttactgagcccgtaggcggtattgggtgaaggggggtcactctccataatcgggtcgtaggtcctctcgcgtaccggaccgaacacactcagcgtactgatgaaaataaactgcttgggaatcatgttcagctccctcagcgtatcgatgaagtatttggtctgcaggtaattcaccaaatcgaattcgttcttgtccacgcacttcgtcacaccggcacaatgaacaatataatcaaacttattgtaggtccctttatgtcccgaaagctgcgccctcagttcattgggatgcgcaaagtccagttcgagaaaatgtatcttgcggtcacgcagatactcgcggctgctggacgagcgtacacccgcccacacaccgaacttgcgcttcaacgcttcctccacgatgaaacttccgataaatccgcttgctcctgtaattaaaatcgattccacttcttcagttacaaattactaattacttttcatccgattacttttcatccaatccgtcaccttggcgctcctttattactttgtcgcctcgttactcttcttcaccggctccacatggatgctgaccagtgttcctttgccgaactgccttttcaacttgttctccaccgccgttgccgtctcgtgagcttcctccagcgagatgctgccatccatacgcacatgcacctcgatggcacaataactgccgatgcgacgcgtacgaaggtgatgcggcgagctgataccgggaaaagagagaattgtctttattatctcatcctctacctcggcaggcaatgatttctccaacagttcgtccacacacggtatcaacaattgcacagccaccttcataatgaagaagctgacaataaccgccgccaccgggtccagcacccgccaatggtcacccaaaagaatggctccacctatccccactgccgtgcctatggatgaaagcgcatcactccggtgatgccaggcattggcaacaaccgcctgcgaattcaacttcctacccttgaaaacggtatattgataaagcacttccttgaaaacgatggataccaatgcagccaccagcgccagcataccgggctcctgcaaagaaccgccttgcaggaaacggtaaatggaggaagccccgttccagaaaatgccgaatcccacaaacaacagaaagacaccgataatggcagttgccagcgtctcgtacttgccatgaccgtaatcgtgcccctcatcctcgggctttgctgagatgcgcacaaatacaatgacaataatatctgtaatgaaatccgacaaagaatgcaccgcatccgccagcatggcggcactgtgccccacaatacctgcaaagaacttgaagacaagcaagagaaagtttaccacacttcccacaaccgtcacccggtaaatgtctttttcccgtgtggcatctgcttttttgttcagagtttgcatttccatctgcttttcgtctaaggtacagcctatctcgctttttgtgcaaatatagtacataaatccattacaatctgtcgtctcttcattattttcaatagaatgataatattttgaagtctgagtgaacgaaggaacgtatttatttgtttactttgcaagagagaacaatgtgcacattaattcattatcattatggccaaaaagaaagaaaagaaagccggcaaacgcatgaagaagaaagaactcgtcaaagtgttgcttgaattcttccacacaaagcaagacgaagtattatccttgaaatacatctttgaacaacttcacctcaccacacatccgctgaagatgctgtgtatggatatcttgtccgaactgtcaatggacgactatatcacagaagtggacaaacacaagtacaagctgaacaaccacggtgtggaaatgaccggaaccttccagcgcaaaagcaatggcaagaactccttcatccccgaagatggaggtgaaccgatattcatagccgaacgcaactcggcacatgccatgaacaatgataaagtgcgtatcgccttctatgccaagcgccgcggacgcgaagccgaaggagaagtcatcgagatactggaacgtgccaacgacaccttcgtgggtaccctggaagttgccaagtcatacgctttccttgtaacggaaaaccgtacgcttgccaacgacatcttcatccccaaagagaaactgaaaggcggcaaaacgggcgacaaagccatcgtaaaggtggtggaatggcccgacaaagccaaaaaccccatcggtcaggtaatcgacatcctgggacgcgccggagacaacaccaccgagatgcatgccatcctcgcggaattcgggctgccttatgtctatccagccgccgtagagaaagccgctgacaagatacccgccgaaatctccgccgaggaaatagcccgacgcgaggacttccggggcgtaaccaccttcaccatcgaccccaaagatgccaaggacttcgacgacgccctctccatccgcaaactgaaagagggactttgggaagtgggcgtacatatcgccgacgtgacccattacgtgaaagagggcggcatcatagacaaggaagccgagaagcgtgccacatccatctacctcgtagaccgcaccatcccgatgctccccgaacgattgtgcaacttcatctgctccctccgccccgacgaagagaagttggcctattccgtcatcttcgaaatgacggaaaagggagaagtgaagaactcgcgcgtagtgcataccgtcatcaaaagcgaccgccgcttcacctacgaagaagcccaggagattatcgaaaccggcaaaggagacttcaaggaagaggtgctccaactggataagcttgccaaaatactgcgtgagaaccgctttaaggcaggagccatcaacttcgaccgctacgaagtgaagttcgaaattgacgagaagggcaaacccgtcagcgtctacttcaaggagtcgaaagatgccaacaagctgatagaggagttcatgctgcttgccaaccgtaccgtagccgaaaagataggccgtgtgcccaaaggcaagaaagccaaagtgttgccataccgtattcacgacctccccgacccggagaagctggacaacctggcacagttcatcgcccgtttcggctacaagctgcgcaccagtggcacaaagaccgacatttccaaatccatcaaccacctgctggatgacatccagggcaagaaggaggagaacttgattgaaaccgtctccatccgcgccatgcagaaggcacgctactccgtacataacgtggggcactatggtctggctttcgattactacacccatttcacctcgcccatccgccgctatccggatatgatggtgcaccgtctgctcaccaagtacttggaccagggaggccgcaccgtgtccgaacagaaatacgaagccctctgcgagcacagcagtaacatggagcagatagcctccaacgcggaacgcgcctccatcaagtacaagcaagtagagttcatgaccgaacgcctgggacagaccttcgacggtgtcatctccggtgtaacggaatggggcctctacgtggagctgaacgaaaacaaatgcgaaggcatgattcccatccgtgacctcgacgatgactattacgaattcgacgaaaagaactactgcctacgcgggcgccgtaaaaaccggatatacagcttgggagacgccatcaccgtcaaagtggcacgcgccaatctggagaagaaacaactggattttgcactggtatagaataaccctataatttaaaatcatccccgatccctttctttcagagagagaccggggatgagacctgcacgatgaagacgattactattacggaccctacacagattgaggaaattatccgcaaatgtccatattgcatagtgggcatcacagaccttgaaggaaacccatatgcggttcccatgaactttgcctatcaagacggagtgatatacttgcattccggcccggaaggtagtaaagtggagatgataacaaagcacccgcaagtttgcatcaccttctgcgaaggacacgaactggtctatatgcaccggcaagtggcatgcagctatagcatgaagtcgcgcagtgtcatctgccatggaaaagtacacttcgtggaagacatggaagagaagcgacgcgtactcgacatgctgatgaagcaatacacggagaatgaatgcaaatatgccgaacctgccgtacgcaatgtcaagatatgggaagtgaaagtagagaaaatgagctgccggtcgttcgggttaagaccaagcgaactataaataccatctgccagctacctgctccacattgatggagcggataaccggcagaaatgtttgctcttacaatgggtattcctcaaacgcatacaacagcgtcgaaagataccgttctcccgtatcgggcagcagcgcgacaatcgtcttgccctcattttcgggcaaccttgccaggcgggcaaccgcagcaacggcagcccccgaagagatgccgaccagcaatccctcatacttcgccagttcgcgacccgtacggatggcatcatcattggatacctgcagcacttcgtctatcacggcactgttatagttcttcggcacaaatcccgcaccgataccttgtattttatggggaccgggctttccgccggaaagtacgggagaatcttcgggctccacagccacaatccttaccttcgggttattggctttcaaggctgcgcccactccgctcaccgtgcctcccgtacctacacctgccacaaaaatatccacccgaccgtccgtatcacgccagatttcctgtcccgtagtacgctcgtgcattgccggattggcaggattatcgaattgctgcaaaatcaacgaaccggggttggcggccttcagttcctcggcacgggctatggcgcctttcataccgtcaacacccggagtcagcaccagttccgcaccgagagctttcaagaggttgcggcgctccagactcattgtgtcgggcattgtcagtatcagcttgtaacctttggcggcggctacaaaagccagccctatgcccgtattgccactggtaggttcgatgagggtggcaccgggcttcaacagcccttttgcctcggcatcttctatcatggcaagcgccacgcggtccttcacgctaccggcagggttaaaatattccaatttggcgataacacgggctttcaaacttttattcttgttataattattcaactccaacaagggagtgttgcctaccaggtcggtaaggcgttctgctatcttcttcataatccaactgttttaaaaaccctcattccccctaagggaaaagactaacaatccggagtggaatgaggtacgttatttcttacaagacaaaagtagcgcaaaatcggttcgtgggaaataccacaaatatggtaaatatgtactataaatgagggatatgtaggatatttgacgagtatttcctatctttgcctccacttttaaacttaaggatatcataatgagtccactcaactttacccacattttgacacaagcagtcgatgagctatcggaaagcgaatcatacaagggattgtttcaccagcatacggacggcaatccgctgccttcggcaaaagcgctgcgcgacatcatcgaactggcgcgggccatcatcttccccggatatttcggaaattccacggtcaacagccgcacggtgacttaccatatcggtgtcaacgtggagcgcttgttcgacctgctgaccgaacaaatccttgccggactctgctttgcaggcgatggcgaatgcaattgttgtaccgagctccaacgggaagaagccgctttattggctgccaaattcatcagcaacctgccggccatgagacgggtgcttgccacagatgtggaggctgcctacaatggtgaccccgccgcacagtcgttcggcgaagtcatcagctgttatccggccatccgagccatcagcaactaccgcattgcacacgaactgctcaagttgggtgtccccctcattccccgcatcatcaccgagatggcgcatagtgaaacaggaatcgatatccatccgggagcggaaataggcggttattttaccatcgaccatggtacgggtgtggtaatcggcgagacctgcatcatcggcaacaacgtaaagctgtaccagggtgtgaccctcggtgccaagagcttcccgctggacgaagacggcaagcccatcaagggtattccccgccatcccattctggaagacaatgtgatagtctattccaacgccaccatattgggacgcatcaccatcggacaaggagccactgtgggcggcaatatctgggtgacggaggatgttccggcaggagcgagaattgtacagacaaaggcgaagaaatgagaagcctcaaacctcgtttaaaaggcaatattgctgcatttgtcaggcacttgtgtctgtcacgtcagacacaagtgtccaacacaacaaacaccggtgtctgagccaacagacgccagtgcctaacaaacgggaggcaaattactgataaacaatagaataaaaacagtaaaatagtaaataaatagatgagcgaacaatcttttgaaatgattgccaaaaccttccaaggactggaagaggtactggcacaagagctgactgcactgggcgccaacgaaatagaaataggccgccgcatggtatctttcagtggtgataaggaaatgatgtacaaagccaacttctgcctgcgtacagccatccggatactgaaacccatcaaacactttacagccaaggatgccgacgaggtttacgaacagattaaagccatccgatgggaagactatctggatacggacaagacctttgccgtggacgcggttgtattcagtgaagagttccgtcattccaagttcgtttcctacaaggtgaaggatgccatcgtagactatttccgcgagaagaccggcgaacgtcccggcgtgcgtgtcaacaaaccggacgtgctgctgaacatacacattgccgaaaccaaatgtacgctgtctctcgactccagcggcgaatcgctgcaccgccgcggttatcgccaggaagcagtagaggccccgctgaacgaggtgctggccgccggcatgatattgatgactggctggcgtggcgaatgcgacctgatagacccgatgtgtggttcgggaaccattcccatcgaagcggcgctgattgcacgcaacatcgctccgggcgtattccgcaaggagttcgctttcgagaagtgggtggattttgaccaagagctgttcgacacgatatacaatgacgacagtcaggaacgcgaattcacacataagatttacggttacgacaacagcccgaaggcaaacgaaattgccacacacaatataaaggctgccggcgtaagcaaggatgtagtattgaagctgcaacccttccagcaattcgagcaacctgcggagaaatccatcatcatcaccaacccaccctacggggagcgtatctctaccaacgacctgctgggactttactccatgattggcgagcgtctgaaacacgcctttacgggcaacactgcatgggttctatcttaccgcgaagagtgcttcgaccaaatcgggctaaaagccacctccaagatacctttattcaacggtgcactggaatgtgaattccgccagtacgaaatcttcgacggaaagtacaaggaattccgtgccgaaggcgaggagttgagcaaggagcgcaaagaatttcgtccggcttcaggagaaaggaaagagttcaaacccggagaaagacgcgaattccgtccccgattcagtggagagagacgtgaattcagtggcgaaagacgcgaattcaacggtgaacgcagaccaagagaattcaaggacggcgaaaagcgagaattccgtccgcgtgaaagaagagagttcaaagacggggaaaaacgggaattcagaccgagggaaagacgcgaattcggtggagaacgcagaacaaagtcgggtgagtcttacccggaaagaaaaagaagagaggcgggaaagaaggaagaagaataacacgaacaatgacaaggagaatgaatgcaaagaaaataagtaagagcattcttgcactgctgatggcagtgcctgctctgtttacaacaaacgtcatggcacaagaactgaaaaagccgaccctggaagaccttattcccggaggtgaaacctaccatactgccgaaaacaagtggtaccagtggtggggcgatgccgcttgtctggaacttggcatcgacaatatagaaggtacatgggctgtcaaaggattaggtgccaagcccggagagaaattcactgccatcacattggaagaagccaacgcgctgctggaagaaaaaggacttggaaaactgcgtcactttcatgctgcaaaggctgtcaacgtaccccgaggcgtcaatcagggtattcaagtccaaatagacccactcctgctgctgaacaccggcaagtaccgtgccctcgtcgactggaagaagaaaaaagtcatctggagccagccttgccccgcccaagccgcaaatgaggattggaacgaggtaagccgccatttggcttatactatcggcaataatctctatgtgatgaccagtgacgggcaaaccctgaaagtcaccaacgaaccggaaggtatcgtctgcggacaaagtgtgcaccgcaatgaattcggcatttcaaaaggcactttctggaatcctgccggggacctgctggccttttatcgaatgaacgaaagcatggtcaccccctatccattggttgacatcacgacaagaatagcactggtggataaaatacgctaccccatggccggcatgctcagccatcaggtaaaggtaggtatctacaatccggctactcaaaagaccatctacctggacatgggcgacccaaaagaccgctacttcaccaacatcacctgggcaccggatggcaaaagcctctatctgatagagctaaaccgagaccagaaccactccaaactgtgccagtacgatgctgaaagcggaaagctgcaacaagtgctcatcgaagagagacatcccaaatatgtggagccgcaatctcccattctattcctgccatgggacagctacaagttcatctatcaaagccagcgtgacggcttcaaccatctgtacctatacaatacggaaggggaactgttgaagcaactcacctccggcccctggcttgtacaagacatcgtaggttttaaccggaacacgaaagagctcatcatcaagagtacggaaatctctcctttgcagagcaacctttacgctgtcaacctgaagaatggcaaacgcagcctgataggagacccaaccggcgtgcactcggcacaaatctccggtttcatgggaacttacctcatcgacaatgcctcttcgcccacttgcccccgtatcataaaactgatgtccaccaacccgaagaaacaacgggaacacacactgctgacagccaagaacccctacgaaggctttgaaatgcccagcatagaagtaggcaccatcaaagccgcagacggcaagacagacttgtactaccgcctgataaagcctgccgacttcgacccggcaaagaagtatcccgccatcgtctacgtatacggcggcccgcacgcccagatgataacgaacggctggatgaacgatgcccgcggctgggacatctacatggcaaacaaaggctacatcattttcagcctcgacaaccgtggcagcagcaaccgtggactggagtttgaaaacgccaccttccgccagctgggcatcgaagagggcaaagaccaggtgaagggcgtagaattcctgaaaagccagccttatgtggacggagagcgtatcggcgtgcacggctggagcttcggaggacacatgactacggcgctgatgctgcgctatcccgaaattttcaaggtaggtgttgccggcggacccgtcatcgactgggcatactatgagataatgtacggtgaacgttatatggacactccgcagacgaacccggaaggctacaagcagacgaacctgaaaaaccttgccggtaacttgaaaggacatctgctcatcatacacgacgaccacgacgacacctgcgtgccgcagcacaccctttcattcatgaaggcgtgcgtggatgcccgtacctatcccgatttgtttatctatcccacgcacaagcacaacgtcctgggacgcgaccgtgtgcatctgcacgagaagataaccaggtactttgaagattatttatagaaaggattagggattaaggatttgcacatcatgctatacgacgggaaacattaagagttcactaaccgccaatccctaagcactaatcacttataacttataactcataatttataactccatgaaaatattattattaggctccggtggccgcgaacacgctctggcatggaagattgcccaaagcccgaaagtagagaaactatatattgctcccggcaatgcaggtacaagcgaagcaggcgagaatgtgaacctgaaggcgacagactttcccgcactcaaggcttttgcccttgagaaagaaatcgacatgattgttgtgggcccagaagacccgctggtacaaggcatcttcgacagtttcaaggaagaccctgccacttgccatatcgacatcatcggccccaccgccaaaggtgccacactggaaggtagcaaggaatttgccaaaggtttcatgatgcgccacaacatccccactgcccgctacaagagcatcaccgccgacaacttacaagaaggactcgatttcctcgcaaccctcgaagcgccttacgtactgaaggccgacggactctgtgcaggcaagggcgtgctgattctccccacactggaagaagctcagaaagagctgaaggaaatgctgggcggcatgttcggcgatgccagcgccacggtagtcattgaagagttcctcagcggcatcgagtgttccgtattcgtgatgacagacggccgccactataaggtattgcccgtagccaaagattacaagcgtatcggcgaaggcgacaaaggcctcaacaccggcggtatgggcagtgttactcccgtaccttttgccgacgaaacatttatggaaaaagtacgcacccgcatcatcgaacctaccgtaaacgggctgctggaagaagaaatcggctatcaaggcttcatcttcctgggacttatcaacgtgaagggcgaaccgatggtcattgaatacaacgtccgcatgggcgaccccgaaaccgaaagtgtgatgctgcgcatcaagagcgacctggtagacctgctcgaaggcgttgcccagggcgacctcgaccagcgtacactggaattcgacccacgcacagccgcttgcgtcatgctggtgagcggaggatatccggaagcctacgaaaagggcaaggtgatgaccggattcgagaaggctgccgaaacagacagcatcctcttccatgccggaacagccaccaaagacggacagaccgtaaccgccggtggccgtgtcatcgccgtctgctcctatggtgaaacgaaggaagaagccttgcagaagagctaccgcgtggccgacatgatagacttcgagaagaaatatttcagaagagatataggatttgatttataaatgagaacgaagagattccagaaccggataacggcagggcggttcacactacccgccgctatcttgatttcagtatcctgctggatactgactgccgttctgttgcccgagacggagacacagcaaagcggatattccctttgggaaacattctgcgacttctgcatccccacctgggcaaaccgtctcttcagctttattctgtatgccgtcatcgggtatttcctgatacagctcaacaatacgttcgccatcatccggatgcgggcatcggtacagacttctgtctacttcctgctgatatccgtctgccccagcctgcacatgctgtatgcgggagacttggcatccgcctccttcctggtggcactgtttttcctcttcaggagctaccagcaggcacggcccacgggcagtctcttccacgcctttgtcttcatcggactgggcagcctgctttttccgcagctcatgctgtttgtccctatcttctggataggcgcctacaacttccagtctctccaacccaaaagtttctttgcttccttggtaggatggagcgtaccctactggctgttgctgggacacgccctctactacgggcaaatggaactcttctgccagcccttccgcgagctggtgaccttcgctcccatccggttcgactatcagccgtggaaactcgccacccttgggtatctccttgttctgttcatcgtcagcgcggcacactgtctcattgccggctatgaagacaagatacgcacccggagctatctacacttcctcatcctgctgaatttctgcatctttgtctatatcggactgcaaccggcattgagtgtccacctgatgtccttcctgctcatcggtgtcagcatcctggcgggacacttgtttgtactgacaaatagccgcagttccaatatattcttcatttgtgcatttatcggattattcattctattaggattcaatatatggacgcttttgtagatacactcgtacagctgctgattgactggggatatgtcggtctgttcatctctgccctattggcaggaagcatcattccgttcagttccgagatagtgatggtagcactggtcaaggtcggtctgagcccggcactgtgcgtactctccgccaccttgggaaatacgctgggaggcatgacgtgctactacatgggacgtctgggacgtatagactggattgagaaatatttcaaggtaaaaagggaaaagatagaacggatgcagcatttcctccaagggaaaggggcactgatggctttcttcgcctttctgccttttgtgggagaggctatagccattgcactgggcttcatgcgcagtaatctgatgctgaccaccacgtccatgtttgcagggaaactggtgcgctacatagctatgctgtgggcactacaaggagccatttcgatgatgaattattgacatgtagtgagtttgagcaatagatgtatagatacaacgcgttggatgtatagatgcaacgtgctggatgtatagatgcagcacgctggatatataggcgcaacaacacgctgaatcacagagaattaaactaaataaaaacattcaacaaaagcagaagtgatgcaacgaatcatagagaagacggaagacggaagtgcgacactgtttgtaccggaactgaatgaacattatcattcggtaaagggggcacgtacagagtcacagcacatcttcatcgacatgggactgaaagcatccgctactgcccgcccgcatatccttgaaatcggtttcggcaccggactgaatgccctgcttacactggaaactgccgaaaaggaaaagagacctgtgcactatatcggtattgaactctatccgcttgcatggccggaggtggatgcgctaaaatatagcgacaatcctctgttcgaggaactgcatcgggctgcgtgggaagaagaagttgccataactccttatttcacactgagaaaagtgcaggcagatgtcgaaacaataaacattgacagtttgttaatgattaacaaatctccgtttgatgttgtctacttcgatgcctttgcacccgaaaagcaaccgggaatgtgggaggaaaaagtcttccggaatatccatgccgccatgagcactgatggcgtgctgaccacctactgcgccaaaggagtagtacgtcgcatgctgcaagccataggattcaaggtagagcgtctcccaggtccccccggagggaaacgggagatactgaggggaaggaaagaggaagtgataatggataaggaatagttgataatgaatagttgatgccccctgccacagcgcagccaaattgtaaattgtaaatagtaaattgtaaatgaaaaagttttgttttttactcctcatagccaccttgctcttctcgtgcaagcaaggaggccaacagaacaagaagaatgacgataaacccgtgattaccgtcaccatcgagccgctgcggtatttcaccgaagccattgccggcgatgaattcaccgtcgtcagcatggtgcccaaaggttcaagtccggaaacctacgaccccacgccccagcagctcgtcgacctcgcgcaaagtaaggcctatttccgcatcggctacatcggtttcgaacagacatggacggaaaaactgacggacaatgctccccacctgcaattcttcgacatgtccgagaatgtggaacttattctggacgagacccatgcgcatcaccataaagacggacatgtacacgaaggccatacgcacgccggtggtgtggaaccccacatctggaactccaccatcaacgcccaaatcattgccgggaacattctgaatgcactctgcaccatagacaaagccaatgaaaacgcctacatggaacgttacaacgcactcatccggcggatagagcatacggacagcctcatctgccagatgctttccagtccgaatgccgaccgtgccttcatgatttatcatccggcactttcctactttgcccgcgactacaacctgcaccagattcctatcgaagccggtggaaaggaaccctctcccacccatctgaagaacctgataaactcctgcaagaaggagaaggtacgcatcatctttgtacagccggaattcgaccgccgcaatgccgaccttatcgcccagcagaccggaacccgggtggtggctatcaatcccctctcatacgactggaaggaggagatgatgaataccgccagagcgcttgtaaaagagtaaacgatgattctgtccatttaacgaagaagaagctatgcctgcatcccccattatagagataaagaacctcagcgccggatacgataaccggaccgtactgcatgatataaaccttattatctacgaacgtgattttctgggcatcatcggccccaacggcggtggaaagactacccttatcaaatgtatactgggactgctgaaacccactgccggggagattctataccactcctgccccccatccccctccgaaattgccaattgccaattatcaactgtcaattgtcaattatccatgggttacttgccccaatacagcagcatcgaccggaaatttcccatcaccgtagaggaggtcatcctttcaggactcagcagcaagaagccgctggcttcacgcttcaccgcccggcaccgcgagaaagcctctgccgtgatagcccgcatggggctggaaggcatggagcagcgtgccatcggcgccctaagcggcggacagttgcaacgtgccctcctgggccgtgccatcatctccgacccgcaggtggtgattctcgacgaacccagcacatacatcgacaagcgtttcgaagcccgcctctacgaactgctggcagagataaacaaggattgcgccattattctcgtcagccacgacatcggcacggtgttgcagcaagtcaagtccattgcctgcgtcaacgaaaccctggactaccatcccgataccggcgttacggaagaatggctggaacgcaacttcaactgcccgatagagttgctggggcacgggacgctgccacacaggatattgaaagaacacaagcattctcacggatgactggaagcaaaggaggccggcccattgtagaaccgacctcccgttacccttccgaataactatccgacaatcttcttacccgtcatttatattggaaagccttatacgaatggggcagtaatgacaaacggaaagagttctttggtgtcaccggacgcctgctctgtacgggttcggcaggaaggggagccagaatatccccattctccagattttccaacctcgtcacctcatcatcggtaacaatacgcacttccaccggttcatcattgaagttctccaccaccagtgttttattgtcatacacaaacaatccgactttggagggagcctccaaatagatatccatatccctactcataatgcggcgaatctcattcaaggcttttgccggaaaatcatataaatttcccatatcatcgggaatggtcaatacatatagattgccggcggcatagggagctctcaacaaaataggataccccgatactcctcccgtcaacggacggcccgcactgactacttcccaagcatcattcgtataatactgaacctgcggtatcaataaatcgcgtccggcttgtccgtatcggccaaaatcattgacaagagctttcaaatcggtacaacgcaattccgctatttcggcaattttttcaggaatggctttcagcaagccgcttgtaatcaccacatcccgtccgctttgcaattgcttcctaatgtcggtcatgagctccggagcttgagccgcctgggcagtcagcagcaccacttgttggtctttcggaaaaacgggacgtatatccatcggcaaacctatcatgcccagataattctgcaagaaatcatcacccgccacatgaaaaggcttgtaggacttgatgccaatggggttacccaacttacctatcagtttatcagtctgtttcaatacaacatccgcaatgcgtgccatggtggtaggctctatggaagttccgtccttctgccggataggggcagtcatctcatcataattaaagctggtgcccatgccctgccaaggggtacggaacctgggagacaacttcacgcccagaagctggttataggcaaagagaatgatttcgggagccttggcaagcatggtcagatgcagctgctcagcatagcggtccatgcctagattcagtccaccggagtccacccatcctccaccgttgtagcccggacgcagattatcgaaatagcggataatattatagcttagataattctgcagatgctggttgccggcagggtcccttgtttcggtacccgtccagacaccgtcaaagagttggggaccttcctccagattaaagcccaaaccttggaaatggtcgtaccagttgggatacttgatgattacctttacacgaggattcaccttcttggcaggtttcagcacaaggtcgcgcccggcttcagtcatcagcttcaaacggtattccgtccagctctgcgcacctttggcttttatctctatgtccgacttgcaactggtgaagaaaaagtcatccagaataaactcgtcaaagtgctttgccgtatgttctgcaatctttcgcaccatctcacgatgctcgggattggaatagcagaacgtctcgaaactgtttgcctcgttgatggtgtaggtaattcctccggcagtctctattccccggtcatggaaaaatttcttagcttgctccagggtggcgtcatccacaatcagtaaatcacgatgtgtttccagataaatcttgtccacttccaactgttgtgaaatcacattccaagtcgaatccagccaatggatgtccttcatcttgtctacctcgtaggcacgtacatagaccgataccttaaaattgtcataagcttttgcctgcatggccatagtgcagaccatgcagagcagaaaagctacaattacaaacttatctacctttattttactgttcattaccattcaatattttctgagatgccaataccatatacataaaccacgtagcatgtccgcccaaacagtattcaccttcctgccataagaacgggaaatgaagtaattcgggcaagtcgggacgaatcagatttgtacccggagacactccacccggaatataagaccagtcggcacggttgacaccataggcagctttcatcgtttcggcaccgactcccgttacaaacgctgcctgattacgtcccggatgcataccgagcaggtattggacagcattgaaaatatagtccggtgcaaacaagtcaggataggcagcatgcaggtaacagtaattgtagcccagatgctggggttcccatgaaccggaagaacggttacctctgtcatgcggcaccccatacggagttttactgctatactcctgatacatagcctgcaactccggcagtgctttgcgaacagccttgctgaaacgtgcatttcccacagctttgtcgaaacgtccgatgaaccaacccgtctgacggatattcttgcagatgaaatcctgctgctgcaaaacgaaatcacggtactccacttcctttgtcgccaaataaagttctacggcagcatgtaccttggctgtcagcacccggttgttgtcgcagcgggtaatcctgaacaattcacgggctatctccagacaatccgctctcaatgcatcgttatgtcccttcaagacacgtgaaatacctgccagccaggcagccacctgaagttccctaccagggttgtcctccgtaaacacccagcggtcgtcggcagtcccactgacatggtctgtatgggccgacgcatcacccaagtgtgcatactggcgtacggtaggacacagaatccctctgtagagacgccccagagccttccaacccgccactatcgtcaaagcaccgttttccacctgctgcaacaagtcattctttccatccggctggtgaatctcgactatcttcttttcaaaatctatggaagtctcgtcccaataggcaccaaagttctcacaagccatggcaagtatataggcctcgcctgcctgggattccacacgcaagtcatagtcccctgcatcgtgccatccacccacattcagccctggaaccaaatcacccggctggtacttacaaagagtagaggttccctgagtatatccgtctatatggttgatatcggttttggccatacgtgcatcgtcatgatgacagaagtcatgccatacacggtatttttcgttcacacgcatgtggcacatctgtaccggcaagaagtattccacctctgcctgccagatacccttgtcccacacatctttggcaatgcggaacaccggagaagcagcatcgccgtacattacctgatagagcccttcttccgtcacttccgtgaagtcgaactgcagatagtggtagcgttggaaatctccccaatccttggcagcctgctgctttaccagtttcctgccatcggcagcaatgcgataaagggcaggttgcttgaagtctgtatcccgtttatccaactctatgacagccactttcttctgtccaggatggtaacctacttgagaggcttgcaccaccggtgcataacgccagtctttagtgactgtcggacggattatccatttcaccgcaccttcctttgtccctgccgggaactccgaacggagcacaaaccaaccgttgttatgatttatccttccatcatacagcaacaagtctcctttctcactttcaatcgtaatctttgccaaatcatcctgaggattgagtacaaactttttccctgcggccaaaggagcagagacgatatcatcggcaatcatcgggttataagtctttctatccaacagcaactggtccaaatcagctttcccgtcaggattgaaatctccgatatactccatattggaagactgtttcatggtgggccccatcgcctggtggggaaagactcccgtccggttgtccataatccacggcttgcccagcaaagtggaaggtaccaattccagattaaagcccaacttgccggcaaaccgctcgggcactggttggtctaaatcaacggtcaataccagataatccttctcgcctttgaccttaatggtatagccaaaaacaaaatccggataaagcatcggattaaagcctgccatgtgtttggccgaatccggataactcaatgtgacacggatttcattgtcagcctcatccaccacccggcttctcatcttgggcaatccctgccactgcccttgcgagatttcaaagcgcacatctccattggcagccctgcggtctccattcaaaacaagggtcagtcctccctggtgtccttcagggtagacgtcactgaacaccatcacattggccccgccattctcaaaatatcccgatggattgattctgaaatcctgggcgtgcagccccatacaaagcatcagtgatgctgcacctgctataaatttcttcataaatactattttaaacgattatgtatttctactcccaagcgtaccgtatgatacgggcaacgccacatactcactttgggagtatccttcttgggttctccatcaaaacaatcactgtaccattcaccgtattcccggtctatcatacagtcctttacgaaagtccaaaccgtatcggccgattgcagataaacgtcattcccgctgatttgccaggcattgacacaagctatcatcgtttcaatctggccccaccatgaggcatgcccggttgttcttccgcccttcttttcatacatcatataccctttgtcactcagtccttccgccaagcaagcatccgtcacatccagcgcaagccgattcgccctatccatcagttgccgatcttctaacacacgggcagcctcacaaagcagccatcccgcctctacatcatgtccataagagtccatctcaaccagactgttccatgcattatcaaagaacaaattaaaatgtctccttgaagagtcataaatgcggtccataaacaactcggtgcagaattcgagtcttttcctcagtccgtcgtctttccagcactgatataaaagggtataagcctccagcacgtgcaaatgcgcattcatagtcttgggtgcattgttatcataattatccagttgtttccaatcttcagtaaaagattccacataaccgtcatattgcggttcgcggcctttctcctccaaggtatgatataaaccgacagccatatccagactctcgctgttacccgttgccagatagtgttcagccaacccatagatggcgtaggtcatggcatacgtatatttggaagcattcagcacctcaccgtcaggattgaccagccaatataccccaccatgttctttatctataaatgtatcaatgaagtagcgttgcgatttatccgcaagcttcagataagcctcatccttaaatgtacggtatgcggcagaaaaactccacagaatccgggcattcagaacccctcctctcggagcatccactaccggagtaccattccgcaatacagttccataaaaaccgccgtcgggagccactgcataatccatccaaaacggcaacacgctgtctctgacattcgtgacaatctctgtacgcatgcgtgtctgcatatctgtctcccctgaatacgaccggcagcctgccagacaagacgcaaccagcagtgctatccaataaaacatcttcctttccataattattctctaaaaccatcaaacttttccttgtataattccccgtttatcagaaactggtgttcgtcgtctcaagtactggtgtttgtcatgtcagacaccggctttcatcacgacagacgctgacgtctatcacaacaactactggtgcctgacatttcactcacaaatattttattattaagtgtttatttataatttatcaatatcccggattctggtcagcctgattgatgagcgggttggtcagaatctcattcgtcggaatcgggaagatttcctgataagcctcgtgctcaaagaaacggaatgagtcaccagtctgcagacaagcctcttgtgaagagttggctactgtcttcggatattcggcggcaaaccattctttgcacatacccatacgacacaaatcatggtaaagcgagaactcggcattgaattcatggcgacgctctataatcagcgccaccttccataccggagaagtatagcctttggctgctttatagcttgtataataggtctctgcatccggcacttccaccgtctgggtattcaacatgtcggcgggtaggtcaatcatcgtcgctcccatctccaaattaccccaagcacggttacgtatctgacgtatcatgttccatccggtagcgttgtcacctgtctcgaaacaacattctgcatagtcgagcatgatgcctgcataacgcttcaaagtcaacgaaatagggttgaatactttgttgttctcacctggcttgcatctccagtatttcaaggaataaacagtaggcatattttcggaaccttggaaaagaccgtcaaaaccacttgtcacccctacagtctgcccggtaatgggatgcgtatcccctttggcaacagcagagtattggcggcgtttgtcacccggttcaaaggaacgtacaaactcccaagaaagacagagagacccccagcctccccattcgggtgccgcacacatatatccgtaccacatcatggcatctgaagacgaatcggctccccagcccatatatccttgttcatgatacatcacctcaaatacagattctttggtccaatgtgtatcccaggcatgcaggttaccgaagcagggctccaatgaataggttccactgtccactatatcctttagttccgtcttggctttcgtaaagtctttcttcaacatatacagctcggccaaataagctttgcagaaccccttggttatacgtccgtattcaccattcatgggtaaccagtccagatggtcgcgtccaaaagacaaatcttcctcgatagccgcataagtctcatccacggattccggacgtgcctttcctaccgaagtagtataggtttcaccggtaagcaacatcggtacccttccgaaaagtttcgtcaggtaaaggtagttataaccgcggatggcacgtgcttgcgcttcataaacggtcttggaattgctgtccgcaaatatagaggcatccgccgtctccaggccagccaggaaacggtttgcacggtccactgcacgataactcatccgccatgcagtctctagggaacccttatcgggtttccaggcatgacgctgccattccgcatcccaaccggaagcctgacagtccatcgtagaatggttggcagcaaatacctgaggcttgaatccccatgtttcgtcatcaccggaaccgtgctggtccgtataaaaggtatcataaagtccgttcaatccggaaaggacattctcctccgttttaaacatgaaatctgccggaagaatatcgtaatgatccacttccaaataatcgtcacaagacgttacggtgcttaaggccagcacaccgatcaacagtttatataagtttttcataatcatattttttatccgttagtattagaactgtacactcagaccgaaagtaaccgacatcgggaacggataacgtcctccgtcaaatcccgaatacaatacattggagtcaccgacttccggatcgccgaacttattgtacgaagagatggtacatacattgtcgacactggcaaatacgcgtgcattttccattttcaccggtttcagcacattcttcgggaatgtatatcctatctgaatatttgaaatcttcagataatcccccttctggatgtaggcgtcggacacacgcatgttcttattatagtctgtcttggtgatacgcggatatttggcgccggtattcgaagatgaccatgcattattgatatattccttcagtacattctgataaccgccgtcgggtgcatagactgaggtcaagcgggccgaagaataagaaaggatatccataccggctacaccgtacaagttcatcgagaaatcaaagtttttccaggaagcggtaaggttcattccgtaagtgaacttgggatatccattgcctataacagtacggtcggcatcggtaatctgcccgtcaccattcaaatcaacaaacttatagtcgccgggctgggtagtcttgtcctgatatacaccactttcaactcccttttcaaccgccagcctattcatttcatcaatttcggcctgggttctgaaaatgccttctaccttccagccatagtaggaacctacaggatagccgttctgtgtaatggagtggttgtcccagttgtcgccatcttgtgctgaacctgacttgctgaatatcggatcgccgacttcaatagcctcgttcttcagggtagacccattcagtcttatgccgatattccaatcgctgaagctcttgttccacgcagcagtaaactcgaaacctgagttacggatatgtcccgcgttagtatagacattggagaaaccggtagaaggacgaatctggcgatacagaagcagatcctttgcgtcacggataaagtaatcggcagagaaagaaagctcattgttcataaaggcaaagtcaataccgatatttgtctgctcattggtttcccatttcaggttggtatcaatttctttctgctgggcaataccggcaccgttaatcacactcgaaccattaaagaaccagtacattgcatttgccgaagacaactgtgctatggacaagttggtaccattgcccgcattaccggtctgtccccatccggcacgcaacttcaagttactgaacagttctaaatccttaatgaacttttcctcggaaagacgccaagctacagaagcggaagggaatgtaccataacgattgccggcaccaaagttcgaagaaccgtcgcggcgtaccgttgcagtcacaatatagcggtcgttcaaagtataagtcagacggccgaagtaagaaaggaatcttgtcttcaaatccagcccaccatccgtttgtttagacgatgggtcattggtcaatgaaattttgcggatgttgtctgccgggaaatcgttggcactggaattcagccaggcaccgttcgtatcgctggtagagaaaccggccattgcacttacgcggtgatgctcattggaccagtcatagttcaagaacgcttccagaccgagtgaagtggactggctctggttcagcgagaacgagtccttacggtcttgagttccaaaggttctatcattataggctgtatagccattataaccttttgtataataattataactggcaatagtcttgaaagtcaatcctttgtacaaatcgagttgtaggaaagcactagcaagcatacggtcccatttattaatactgtcggcagtcttggcagcagcaaccagattgtcagctcccttgttcacgtctccattgccttctttcttgtaatgtccccaagtaccgtcgggcaacacaataggcatggaatagaaaacaccgtcctctacataatccatggttggaatggcttgtgcatagtttctcaggttgcctcctcccatcttttccgaatgtgcatagttcaagttcaagcctacatgcagaaagtctttcactttgtgagtgatattagcgcgtgccgtcaagcgtttaaaattcgactcaatcacgataccctggttgttcaaataacccagagataagttggcttgggtattttcgctgcctcccgaagcagaaaggttatagttctgctgtaatgccgtgcgtgacatttcatcctgccagtcaatgctgttcagtctgcctatgtaatcctcgccatatgccagattggtcatggcaataccgtcattcttgacggcggaacgtacagcacttgcaaacaagcccgcatcagccacatcaatcttattcgaattgaactggagggcatagttggccgaaaagttcacctttgccttccccttaccaccgttcttggtagtaatcataatgacgccattggcaccgcgagtaccatagattgccgtagccgaagcatccttcagaatttcgatggactctacatcattaggattcaagaaatcgatggaagttcccacctgcacaccgtccactacatagagtgggtcggcagagccattcacggttgccacaccgcggatacggatggagaaacctccttccgggtcaccggaagaacggatgacagatacacctgccgcagctccctgcaaaccttgtcccaagttcaccggattccgcttcatcatttcctccgcattcacggaagccacagaaccggtgaggtcggatttcttcatcgtaccgtagcccacaacaactacctcatccaaggtttcggtatcctcctttaaaataattttcagagcattcatattcccggttactttgaccgttcgcgccagataaccgatgtaactggtcttcagcgtagaacctacgggacactgcaaggagaagttaccgtccaaatcggtaatcataccgtttgtcgtaccttccacaatgacattggcaccgatgatgggctcgcctttctcatccaccacttggcccttcacagtaactacactctgctgtacgacagtgacacctgcaaacggctgtacgcttgttgcaaagagaggtccggcacatgccagcgatactgacatgatacccaaatacttcatcacatttctcataaatactaaatacttaggtttaacaaataccccggtcataagcacatcgggaaaaagatatgcgacacaattttgtgccactatagaggcactgccgtgccattgggaaggcacatctgtgccaccatagtaatacagatttcggtaactatatccctttctcttccataccggcaggggtgaattcaatatagattttcaaagattaagttcagaaactcagggaagtgccttcaacctggttcaacagttgcggtttggcctttccacaatccactttcacaacctgaatacggttgtcggcaggtagacaaaccaatccttccgcctgcttcttgtcagcactgtataccttcaggttcattttgctccaatccatctcaacagtggactgcgccaacttcagatgaggaagtaccgaaccgtcacgtaccagcatgattatcggcagactgcctgcttcaatttggtgccatccaccttcgtagactttctctgtctggtagtctatccattttccttcgggaaggtaaactgtgcggcccgtcataccggattcaagcaagggggcaaccagaatctgcgaaccgaagagatactcgtcatccactttccatgctcccggatcatcgggaaattctacaaacaaggctcttagcatcggtaagcccttttctgtacattccttagcctgagcatacacataaggcatcagacggtacttcatctctgcactcttgcggaagacatcctgcacacgcttgctgtcgtacaaccacggctctgtcggaggtgccccatgcgcgcgggtatgggaagtaagaaaaccgaacggtatccagcggcaatacaagtcctccggagtggcttttacaaagccacccatatcatggctccaaaaggagaaaccggacaagccgaaggacaagcctgcacgaagcgtacctagcagtcccgtgttcgtagttgcagcatcaccgccccaatgcaatggataacgctgggaaccggcccatgcggcacgtgcccacattatattctcgttgtgcaacttcttggttatctcggacactgccatatcataacgcaccggatagaggttatgctcataccatccgctcttgccggaagcgtaaataccgttcagtggagcagcctcgccgaagtctactttaatggcactgacaccgatattcagcaatcccgccagtttgtcctgataccactttacggtttccggattggaaaaatcgagcaccacatcttcgtagggaagttcaccatttccatttttcacatacatgtctttctctatcagttcagagaaataacgatttttaggagtgaaataaggcaactgccacaaacatacatggaaaccttgtgacctcaaatccttcaacatctgctgtggattctggaaacggttctcggagaatttatagtcacactgccagtccacatcaaaccagccggtatcgaaatggataacatcgcacggatacttgttcttacggatattggccgctacatcataaccttccttttcactgaaataggtaatacggctcatccacgtaccgaaagaccacaaggggggcatgcccggctttcctaccaaatcggtgtactcgtccagaatatctttcggctcgccgaagaaaacgaacaaatccaggttctcgtcacccatgaacattttgttcagcccaatataggtagcaccaaaatcacaagtcacgggagcggatgtatgcataaacatgccatatccccggttactcataaagaaaggaatcggtttgtacatctggtccgtctcaggcccttgtgggtctgtaacaaacaagttcaccttctgtccggccttgttcagcccagtggcagactctccgcaaccaaaaatcatttcatccgcagtcaaggtaaataccggattgatgcggcgggcattgtcacttccccgcttcacaaaacagaacggtgtatattttacctgcgtagagtccgcatcactcaaagcggcagtctggctcaagatacgtccggctttatccttcaagacgattctccagggattcttgttaatctgaatggttccatagtcactggaatagacaatcttgtcattcgtctcggtaactttccagcttccatccctgcccggttcctttaccaacatgatggaagcggcaggtttaggttccaccggggtcgttagcatacggatacgtaccgtacgcggagttacaaagtcaatcttgaatttgaggttagggtcattttcataggcagtgaaaggaaaatcgagcattctcattttccggggctgtgcaccgttggtattgaaggcttgacggggcatcagatgcccgcgtttccagttcaccagcccttcacccgacttggcatcgaatgactccaggtgatctgcaaaaaacaaagtattactcaagtcacggaaatcggtactcatgtccagaggttggttcatcagatacgaggtaccgtcattgacatgtggctgtgccaacagattgccgccggcaaacaacagcatcgccactgctaaaagttctttcttcatactattaggatttaaatgatcttgcctgcaaatgtatttttcttaaaggaaacacagatgccttaaaaatgtcttttaatatccggttttgtttcatagaacccatataggatcattggaaacaaaatgcatactatttttcaccaaacggaggatatcatcccacgcgaatacgcaaatcttcccttgctcgttcggaggattatatttaagtttgcagttacaatattgttaatccttctaataaagaaaatacatgaaacaactgctcctattccttatatgcaacctgacctttctccttactgttcaaggtaactcaacggaaatcccgccggctgtcatgttcaagcagctctctacaacagaaggactctccaacaacagtatccgaagcatctacagagacaataggggattcctctgggtggggacagaatcaggactcaacaaatacgacggctactccttccagcagtattaccagaacaactccaacctgccggacgatgccatcagcgaaattttcgaaggaccggacgacaatgtatggataaggacttccagcggctacagtatctataattataagaccggtaaattcgacaatgactataaacccatactcgatgggctgcaaatccccagtaaaaacattctgaggatgggaaaaacctccaagaatgaattttgggcctacgactattccaaactttacatacgaagcatggacaacagctccatcaaagcctatccactggcagttgaaaagatttcaagcctctatataggtgtccagttcatttatataatgtactccaacggtatcctatacagtatcagcaagcagacttccgaagtcaaggaaatagccattcccgccatctatagacctttgctggagaatcatgagccacacatttacatagaccaaaacgaaaacctatgggtatacaccttccaaaacagcctgcttttgcacaagaacagttttacacagcaatgggagaacatcagcctgaacaataacactcacatacagtacaatcgcgtgcaacgcatcctcgacctgggagacggcaacgtatggatacttaccagccatatggggttgttcgtttacaacgccctgaccaaatctcttaccaacttggtgcacaatccattgaaaccgcacaccattgccagcaacaatctgaataccatttaccgggacaaagacggaaccatatacatagggaatttcaaacacggtatttcctattatagccccatgtctcaaatcatactatgcaacaaatccctggaatatgatgatatcctaaccttctgcgaagacacaagccaggaatccatttactacggaacagacggtacgggactaatccgacgttcactggtgaccgattcatacgaaaagatagcaactcccgccaatattgtagtcgacttatccatcgactccaaaaaccgcctatggataggcaccttccagaaaggactgctatgctactcgaaagggcaaatcaaacaatacacggtaagcaacagccagcttctcgaaaacaatgtgtatacagtagaggtggacaaacacggatacatctggataggtaccatgaaaggatatatacagaggttaaatccggaaaccgggcagtttgacaccatcttgtaccgtccgggagaattctttgtccgtgatatgtactatgacaaagacagcaccctttacgtagcaaccagaggaggactcattattatcgatacggaaacccaagcctataatatatacgccgaagccagccgtttcaaggagaacaatatgctcactgtctataaggacagccgggaccttctttggataggacatccacacggactgagcatatggaaccagaagaacgactccatctacttccttgaccagaaaaacgggcttgccgccaatctcgtcagagccatcacggaagacaacaacaaccaaatgtggattggcaccggcaacggcatctcacgaatcaaaataacaaacgatacatacaccatcgtgaactactccgtaagcgacggactgatatgcaacgataccaatgtccacgccatcctcaaactgcagaacggcaatatactgataggtactcctcaaggttaccagactatcattccacaagacatcctgaccacaagttatgatgccaacatttaccttaccgacattgaattcaaatccggaatgccccatccggacatcctgaacggcagctcacttgaatgtgcacaacatctttccttcactgaaaaggaaaattcattcactctgtccttctctgccctcgacctggtggaaacggataagataaaatatgcctataagattcattccaactggatttatgttgaaaacaacaaagtaaacctatccatgctgactgccggaaactatactttatccgttaaggcatgcaactcacaaggcatatggagccccaacgtcaaggaactgaaaataaagatactccctccttggtggcgcacctggtgggcctataccatatataccggtatcattttgtgtatccttctgtccattatccgcaatctgcgcttacgccaaaagcagaaacaaatcatgcaggccatcgaggtggaaaatgaaaggcagcagaaaatcaacaatatgaaactgcagttctttgccaacataagccacgaactgcggactcccttgtcacttatcatcaatccgcttgaagagtttttcgtagaccatcccgaatatcgtaaaggcattctggatatagtcaaacaaaatgccgactatctgctggaattgattaaccaactgctggatttcagaaagctggatgccaaggctgaaaccctgaaatgcaaacatgacaacatccttatcattctgagtgaaatattccactctttcgatccgatagcacagaaacggaacatcagctatagccttaccgctccacaacattctgtattcatggattttgactatggcaagatacgcaagatatgcacaaatatcctgtcaaatgcattcaagttcactcccaataaaggaagcatctcactggatattgccgtaagaggcacaaatcttgagctgacctttaccgacaccggttgcggcatagaagataaatccaaggagaaaatattccaaagattctatcagtcgagcaaaaaccagtcgagcaacggaggcagcggcattggactgcacattgtttccgaatacgtaaagatgcatcagggtactgtctgtgtcagggataaccagccttgtggttctgtattcctgattaccctacccctgcaccagaacagtaatgaaaccaaaaacggagaaccggtcgaagaaccggaaataaaggaagaatcccatccattcaccatactactcgtagatgacaactacgacttcttgaaatttctctctgaaagtcttgccaggcagtatcatgtattaaaagccacaaacggaaaacatgcactaaatgtactggaaaaggaagatattgatttagtggtcagtgacatcatgatgcccgagatggatggtctggaactatgttcaaccatcaagaatgacatacgctactcccatatccccattatcctcctgacagctaagacaagtgaagaacaccaattggaagggcttagcgttggtgcagacgactatatcaccaagcctttcaatatggaagtcctcaagctgcgcatcaacaagattatcgagatgaacgtcaaacgtcaggaaatattcaatcaggacattaaaatcgagccaagccgtatcaccatcactccccttgaccggcagctggtggaaaaagccatccagattgtagaggacaatatcagcgaaaccgagttttccgtcgaggagctggccagcagcctgaatatatcacgcagctatttctacaagaaaatgattaagataacgggaaagaaacccatcgaattcatcaggaccatccgtatgaaacgtgcacaacaactcttgacagaaagccagatgcaagtttcggaaattgcatataccttggggtataactcccccaaggtattctccaaacattttaaagaagagttcaacatcagcccatccgaatttataaggcagcaggctgaatagcaacattattttgacatcaaagcatccaacgaagacaccaacgccaccaaagcggcactccaattaatggctatctcattggaagcatacgaaccctccacatctgcataagactcatccggcaggttggaagcataagcaatgccatcctgctgcccaggattgggaccgccaaccaggaaaccgggaagaggtgcctctatatcatccgatgtagaaagacgatggtgcggatacagaggactcttcatcccgaaaccggtaacataacaatatcccgtagcattctttcctaaaatgtagtccatattgcggtaggcgttcgtcaggtacgacttctcgcccgtaagcaaataggcgcaaaccagtgaagtggcttggttagcacacccttcggcaaggcatccccagaagaaatctttggcatcgttgccgtaaggagcatggaaaggagagcggtcagcaccccgcacagcctcgacagcatagtccagtaacaggtctttcatggcatttgccaattccacgtcttcaccctgatattccctgcccggttgcagccaggcaaacacgcccaacgcagtggtattgccccaagaaggagtcttatatgcagtcggcagatgcttcttcacttgttcccggtaaacgggctttcccgtagcaagatagagctcggaagccgcccagaagaattcgtcatcggcactacgatcaccgtaagctcccgtaaccacggcaggttgatattgcttgttgaggaggtcctgatgatagagcgcttgcggatgcgcttctgcccaggcgtaagcacgttcggcagcctgtaaagccactgtcgaaaagcccggataatcctcttcgtaaggagtaaacaaggcagaagcctgcgccaaagccgcagcatagtccaatgccgccgttactgatttctgaaccacataacgaggctgcttacactccgtaggcttgatgaatccctcgaacgaaggggtagtcagcttgtggtagactcctccgtcggcagggtcttgcatagtcagcatccatctcaggttatagtacatctcgtccagcaaatcgggcgtgtggtttccgctttccgggatgttcacctgttgacggataaaataatcaggaaagcgggcataaatcgcctgcatcagtccaatggaataggcggagttcacaatatacttgttatagtctccggcatcataccatcctcccggagaagaaatcaccgttcccgccttacgttccggcccggcagcattgggatgtatcagtaccttgtcatcgggatggcctgccggacggctccaccgacccgcataagtcgcttcgatgggcatgcccgtacgttggtaatagaaagatttcaaagctgcatcggccaaaggggacagtactctttcttttatttcgaatgccactgaatctccgttaaccatcagaaaatagtttcccggtgccgtgatgtcactgaaatccaatatcgtcctgctcttatccgaccaagcagatgaagcaatatatccgggcttaccggaaaatacccgattacccgtggctgcatctactatggtaaattcacggacctcaccggtattcaccacagctactttttcctgctggggatagtaccctaactgattcaaacgtatagtttctgaaggatgccctaaagtggccatccctcccagaactgtaaacagacatgtagttatattcatatcactattctttagtaatcatttatattattctatttcaaaactatttatcagacaataaggtaatgaaactgatggccggcaagtgtacccgtacctgcccattctccactttcactgcagtttccttcatgcagtcttttgtattggtcacatagactttcagttccttcacttctgcagggataccggagatgaccgcctcgcaatccgccccattattgaccatatggacggcatattccccacgcaccatatttccgaaagccgcacagtttacgtttttcttgctgctactgaccggaatggccaaggcatcggccggagtggaggccagttgcttgatattccagaaacgttgcgtaggacgcaaaggacctttggaaccataaatgccgtctccccacaacaacgaatagtctgaagtaagctgccactgcaagatggacaatggctggcaaatggcacaaatacgcgtatacagattgatttcataaagtgcaaacgtcgactcattgaatatctcggcataaccatgagcagcggcatccgtactaccctcaccaaccaagagtggtacattgatcgctttggcagcatccgcccacttctttaacgtaacatcatcacaaccacgccatgaatggaaagaaactgcaccaatatacttatgagtctcaagattgttcaaagcaggaaggatgaaatcgaaagtcgtggcatccgaattgtcgccaagcagcatgcgggtaggaagattcaaccctgccagataagcaccgaactccttaatgaaatctgcatgttcctgcggagtgtggaggacatcaatacccaaatccgattcattgaacgagaacatggagaactcaataccataatactgtttggcatacaacagataatctgccatggatttataaatcttctcctttttccggttatccagacgataagcaatgacaccgccttgacgagcataacttgcaggacctccgtcaatggcccacgcaggtggaaaccagcagcttagtattaccggcattcccatcgccttcaagcgctttgccatgaggagactttcctccacccgcttgttcagtcccccattctgtgcggtggcaatagggtcggcttcctcttccggttgccacaatctccacggaaattccacacgtccataggctacacgcaaattttccagacagtaatctatcactttagggtcggcagcaggattctgcaggcggaaattccctccaaagcctgtaaacagactgcccggattctgcatatccaatataatttccgcgtcactatgatctatcactccggaagcatgcagtgccatggacaatgcagttctctcagcctttttcagagtcggcatcagcgagatataaactacggtaccggtggattctttttcaaccgtggcctttacagacttattgaacttgaattccaacttcctattagccgaagtaacggtcagcttcctgccacttgtccttactttggcatcagcgtagttttccggacttaaagcaatacagtaataggctgtctggttcaaagtagtgtccgacagcgcatcaatagaaatctccaccaagccttttcccttatcagtcactttctgatggaactttacacctcgcagagtagtcgtcacttcctgcatatccccctcacgatggaaaacgggacggacctgcttctcctttccggtaatctccatatcccctttcaaggttccgacacgcagggacgactcaaagtctatcaattcaccgtctacacggacacccgtgatattgctccatgccatcacttccgtctgggcagaaagcggcagagacaatatgccacacagcaatgcagccattcccaactggaaaattcgtaaattcttcattatatcaaatatataaaaggttgtcatttcagtcttgtatcaatctcaaaccccatacggctgttatgataaggacaattccacatacttgctttaggttccttgtagcggggagtcccatcttccagcacagttctgaaccattcgccatactccttgtctatcatccgtgatttgatgaagttccaggtacggacggcactgtccagataagattgttcaccggtcagctgccaggcattgatgcatcctaccacagtttccgcctggcaccaccaggaagcatccttcctgattttgtccttatgccgttcgtacatcatggcacccatcgggttgatgccctctttcaaggaggcgtctgcaagttccaaagccacttccctgcatttcccgatgacctccgggtcacccagagcttctgcagcttccgtcagcagccaggaagtttcgatgtcatgcccgtaagagtcaatgtcatccagattgttccagttcgaatcacagtataatatcaggtgatgtgtttgtgagttatacagtttggttgttatcaagtttatcacttttgcaaggcgctcgcgaaggccgtcatctttccatactttatataacgctgtgtatgcctccaatacatggatatgggtattcattgttttggtggcaacaccatctccatcatatcccagctttttgggaacttcccattcgcgggtgaaagattctatataaccatcgtttacggggtctttgattctgctctccacggtccggtaaagctctatggctttttgcaggctttcattgttgcctgttgctctgaaatgttcggacaaaccgtagatggcataagagcagccgtaagtctgcttgtccgtatccagtggagtaccgtctgcttttatcagccaatatacgcctccatactgcgggtcgatgaagtggtctatgaaatagcgttgcgccctgtcagccagtttgcggtaggcagcatcgccatacatccgataagcggttgaaaaagtccagaggatgcgggcattcagtacgcctcctttgggagcatccgctatcggggcaccgtcacgtcccaatgaaccgtaaaaacctccggaagggtctacactgtatttttcccaaaaagagaggatattctctttcaagtctgaggttatctcatcttttaaaatcttatccgcgtgtgattgcgcttttaggaaaggtgcaatcagcagccctactacaatcagcagaaaaacgggaaataggtgtctcataatgtagcgatttaagaaattggccatagttacactgcaaatttacaaaaaaacaagttgtcattactcattgccatcctttttcaagggatacaattggttccgataaaggtcatttttgggtactgaatccttgttttgtcaaacaccagtgttcgtcaagtgctacaatatctgccccagaaacataggcaaacaccggaaaaagatacattttataacgttattggctacaaacaaaaaccatccgtttcctttttagtccgtatattagtggagaattctgtaactcaaaaatagatactatgagaaagagacattttctattcgcatccgccctggcactgctctgcagtagcggtgcactgcatgcacaagatttcaagctgacatcttccggttatttcaagaaccagggagtagacgtcatggcttttgatgacatctatcccgagggacaccaaggaggagtatgtatcatcatgaatggacaccgcgtagcaacgaatggagacatccgactggaagccacccccggacaatggcagcccgtaccgaaacaactcgaccggaagctcagcgacaacagcatcaccgctacgctctgctatcccgactcctcacgccacctcaccggattcaacccgatgatttacccggatctccaccttatatatacggtacaagtggaaagcaaaggtaaacacatagaggtgaccgtagacctggaccgccccattccccaggaattcatcggaaaagtgggcttcaaccttgaattcttcccgggttccctcttcggcaagccctggattatggacggtcagagcggcatcttcccgcaacaacccaactcccccctaatgacaacccaacccaactatctgcatacgggaaattatcatgacggcaagcaatcgctggcagacatggacaaactgataggaaaaggttacagcccgattgtggccgacgacatcatcagcgaaccttatgccaaaggccgtaagtttacctcccgccccgacgacccttacaacaaagtaaccatcgaatcattgagtggtgacctacaactgtttgacgggcgtatgaaccacaataacggctggttcgtactgcgcagcaacataaaaccgggtgtcaccaaaggggtcgtcaaatggattatcactccgaacgtagtggccgactggatgtatcagccggttatccagacttcacagataggttatcatcccgcccaggacaaggaagccgtcatcgaaatggatatacgtgacaatagaaaggaaacggcacaaatcatccgcattgacgcagacggcgagaaagtggtcaagaacgtcactcctgccaattggggcaagttcctaagatacaactatctgaaggtggacttcacggatgtgaaggaaccgggactctacaagattaaatacgatacctccgtatctcctatcttccgcatcgacaatgacgtatatgcccgtggcgtatggcaacccgtactggaatacttccttcccgtacagatgtgccacatgcgcgtcaacgagaaataccgcgtatggcacgactgctgccacatggacgatgcccggatggcaccggcacacaatcatatcgacggctacgaccagaaagagggcctgtccaaattcaaaccgggtgaagtggttcccggagtgaacataggcggctggcacgatgccggagactttgacctccgcatcgaatcccaagccggagaatcctatatcctggcactggcctacgaagctttccgcccgaatctcgacgtgacttccatcgaccagataaaccgtgtgacggaaatccaccagcccgacggtaagaatgacctgctgcaacaagtagagaacggcgcccttacggtagtcaacggctacctggcactgggacgtctctaccggggaatcatctgcaacgaccttcgccaatacgtacttctgggtgatgccgccgccatgacggacggaaaaatcggtaatgaagacgaccgttggatatttacagaggacaaccccggacgagaactgtcgacagccgcccaacttgctgccgtatcacgcgtattgaaaggcttcaatgatacattgagtgtacattgtctcgacattgcccgcaaagtatatgcttctaccgaaagcggcaacaacagagccttgttccccaaagtgcaggcagccgtagagttgtacctcaccacgggcgaacaaccctatatggacttcatcctggacaaccaggagctcatcatcaagcagataggccgaatcggctggtacacggcacgcgtagaacaacagtttgcacagatgaagaacaagaaagccaaagccttctctaccgctttccgcaaagctctggccggatacaaacaagaactggacaagcaagtgcatgaaactccttatggcgttccctaccgtccgaatatctggggtgcaggctgggatatacagcgtttcggcttccagcactacttcctgacaaccgcctatccggaaatattcccgaaagcaccggtattcaatgccctcaacttcattctcggatgccacccgggctccaaccaggcttccttcgcctcgggtgttggcgcacaatcagccactgtaggctacggactgaaccgcgcagactggtcgtacattcccggtggagtcatttccggtacagcgcttatccgtcccgacttcccggaactcctgacgttcccgttcctctggcaacagactgagtatgtgttgggaggaggttcgtcccactatatgttcctggtacttgcagcagaacagttgctgaaacaataagaaagacagaggggggaacaaaaccctctggatattttcttttaggcgcggattacacggatttagtttactgcatccatggattccgcgtaacccgcgcctaatattatagtataatgaaagtgtttatctactttccgttctttcaccaattatccgtacggaacggaatggtaggcaattcatttccgccaatcatcgtaccaatctggaaatcatggaaacagtagcgcacgctgacgggatgggataccttttctgaagagattaccacttcattcgtctgccagtgcagccatactttatcggcaggatgaaatacacggtcctcgcctgccacttcgaagccacgaaggtcatagttacggcagatacccatttccaggtggtcgaaagaaacccaggcttcattgcctttagcagtccatgacttatattgtgggccgaaacagtgtatctgcttcaatccataggtgaggttcaatgccagataactcaaacgttggcccaccttcctcttgttgcggggatggatgttgtatatctcgtaaggttccacaaggtcgttggtagaaatcatggcactgttcggaatctggctttggacacgaaattgcgcttcgcgcaggtaggcagctttctcttgctgagtgcctccataggcataaggagctatttctgcaaagtaaaaaggcaattcgcccagtccccattccttgcgccacagctgcaccatgtcggccaggcgctcggcatatgtttcatggcggcctacgttagactcgccttgataccagatgaatccctttatggtatagttctgaagcggcttcagcatggcattgtacatcagcatggggcggtgcatggggtgcaggcgttcgatggaatcggggttgagggaaatgtccggatagttttccagcaactcccggcttatccaaccttccacagtggctccaccgtaggcactgctgatgatacccacgggaatacggagggcacggctcagtgaagttgcgaaatagtaagctgttgcactgaaatcgggtgcggtctcgatggaggagaggttccaactaccttcgcagtctgtttgcggttcatacgtttgatgcttgggaacggtgaacatgcgcacacccttattttcggcagaagctatgatatcatccaccccattcatgatgcaacagccggcaaaacctttcaagggcatttccatattactctgaccggaagcaagccatacttcaccgattaggacattcgtcaacgtagttttttctccatcatcaaaggttatctcataaggcgtgtatcctgctgccggagttttcacggcaagcagccaacgtccgtccttatcggcacggcaagtcgttgtctgtccattccacgaaggcgtgacgcgtacttcggctttcggtgcagccgttccccacagttttacttccgtctgttgctgaagaaccatattgtcacttaccagtgcaggcagttttaccttggcgcccaatgaagcggtgcagcataatagaatcaatgcaagagttttacttttcatggcatatttatgtttactacttattcagaattcaataacgtgagcaaaaatagggcttttttgctcacgttcatcctttttcaagtcaaaagtttacatcgcattgttccgcagcaatcgtaggaatcaagtcatctttaaacctacaatagaagctatcaacgtagtaataaagaacaaacggatgaaggaaaccgactcatcaaagaatacaatccccaatattaccgtacttaccgcacctatccccgtccacacgggataggccgtcccgataggtaacgtatgcaccgccttggcaagcagcaacatactgatggccagacagacaagaaaacctgcaccccaaagataatattccgtacccgtaacgcctttcatctttcccagacaaaaggcaaagcctgactcaaacagtccggctacaaccaaaataatccagttcatactcaattcttctgtttcattatacatttaaagagggagcaaagataacctttcccgtactcctgccactttacatttgataagaagcaccggataaggtcgaaaatcgtatttttgccacactaagaaccaatacttgcttgataatgaacaaatacgatattatccataccatatatccaatgccaaaggcatctgtcgacaagctggtggagaacattgcggaagtagcttaccccaaaggttccctcatactggaagccggaaagacggagagaaacattttcttcgtcgggaaaggtattgtccgcgcctacgtggaagcaaaaggcaaagaaatcaccttctggattggtgccgagggagccacagtcgtttcactgaaaagctacatcggcaacgcacccggttatgaaaccgtggaatgcatggaggacgtcattctttacgtcttgaaacagagtgtcctggcaagattgttccaagaagacatccacatcgccaattgggaacgcaagtttgcagagacagaattcctgcagactgaagagaaattcatccccttgctgtttacttccgcagccgaacggtacgaagtactgctgaagaataacccggaactgctgcaaagaatcccgctggaatgccttgctacgtatctggggattactccggtgagtttgagcagaattagggcggggattggaaaacgacaaggctgaatagaaataaaagaaaagaaattatacatgaatgtataatctgtatatttgtcattaaatcaagaacaagcagcccataaaatcaccttttcaatacggcacattggtcgataaaggggagcagtacatattctccaacccggtatttgagttgtggttcaagagggagtattactgaaagactctaaattcactaactttgcaacataaacaaaaaacaattacacaatgaataaacattcatactttggattgcttatgagcatcttaatgaccggttgcgccgagagtaaaccggatgcggcagtagagaaagggtactgtccaaaattttgtgtaaatggaaacaggattcagttgtaagtttgttcttatatctggattctgttttcaaatataagcataaactggttcataatcaatccccagtttgaaataggcattgtccatttcttttcaatctccataagtgaaagatacacggtcttttttacggcatcgtccgacgggaatgaaagctttgatttggtgtactttctgatttttccgttcagattctcaataagatttgtggtatagattattttcctgatttccaatgggaactggaagaaaacagtcagatcatcccagttgtttctccatgaaagtatggcgtatggatactttcctccccatttcttttccagattgtcaagttctgcggcagcaacttccttattaggtgcattgtagatattcttcatatccgccgtaaactctttcttatccttataaacgacatatttacaggagttcctgatctgatgttccacacagatctgagtggatgactgggggaatacggtacggatggtatctgtaaatccattcagattgtcagtacaggtaatcagtatatcctgcactccacgagccttcaagtcggtcaggacacccatccagaaagaggaactttccgatttgccgacccacatgccaaggacttccttcaggccgttctgtttcagaccgacacaaagatagacggtcttgtttataatcttgccgttatcccgtaccttgaagacgataccatccatccagactatcagatagaccggatccagaggacggttctgccattcctgcgcagcctggcttaccttgtttgtaataatggaaatggctgatgtagagagctctatttcataaatctcacgcatctcctcctctatatcggaaacactcattcctttggcatacagggagataacaagcttctctatagaaagtccccggctttcatgcttggggactgctatcggttcaaactgcccgttgcggtcacgcggaatggagatgacagactctccatgtccggtctgaattttcttcggataactgccattccgggagttgccggtgttgttccctgccacggaattcttctcataccccaaatgggcatccatctcaccttcaagcatcttttccaatacctgcgcatgcaactgattcagaaacctgctcacatccgcttctgtcttgaactggctaaggaactccttgcttaatacctcatcaggcactacttgattcttttctttcataatctttttcatttggtaaatgtataaaataaaaaatacggaactcgattttgaatcccgtattttccatttacacaaaatattttatagtgccagagaaagaaacactttcatcctgcaacgtcaaactcagtaacatacaatttacccaagccaagaacggggcggagaacaatgtcaccgtattcaacgacacactgaagtttgttgccggtccgcagacagactatttccgttcgccggatggaactgccatcaacaactcacctgttatctttacagagatagacaacacgaagccgttcacctttacagccaaagtggaaccgcagttcaccctgacgggaacatactcagccggcgtactttatgtctatgagaacgatacccacaaccagaaactatgctttgagcaagatgaaaacggagcacaccgcgtggtgagtgtccgcaccatcggaacttccgaagtggcaagcttgataacgaatgaagtaacgtaacgtcgatataactcaacacattgtagaatgcccatcattaatgttattcacatcaatggtgggtattctacttttaccattctgacactttgtattttctatcgtatgaggatcccccgtatttccatctctctgtctatacgaaaggaaattcgagaacaaaaacatataaaatacagattataaggaatatatcaaaacattcctcctcctaataaattgaaaatatatctccgaaagccttgatacgccgagaaagcaaagacaaaagcaatgctttttgtcacatttacagaaatatccctatctttcaagcaatccacccagttcccacgcccgcacatgccgtattccttcattggacggcaggcagaagtcatcaagcgagacaaccagtttctcataattatcttgtatcgcctccaacgaagcatactcacggcgcaccgtctgttcatctaccagcatgtaggtggattgcagatatatcgtacggtcacctttccgagcgatgaagtccacctctttttctttagcacatccggtatagacatcatagcccgcccgaagcaactccagatagacaagagtctccagtttataacccacatcataggctgttccgggatagaggaaattcttaaaggcaaggtcgttgatgtaatatttcgccgtaccggacagtatttcctttccgcgcaagtcaaagcgttcacaacgatacgccaagaacgagtcttcgatatagcctatgtaggcagccacggcatcatagctcgtcttccggccctggctcttgaaatagttcacgatgttgccgatggacactaaattagaggcattgcctacaagaaacgcaaaaaggtcctcaagcagtcgggggtcacgtatgctgtagcgttggatgatgtccttcagcaagatggtgtccttcaaggcagacaagtaattgcgctgcacctcctgcttttcgggcaagacaaaaagttccgggattccgcccgtattcatatagcccatatagctctcacggttctgttccagatgccttatctctgtatactcctgatagctgaagggatatatcggaaattggacgtatcgcccggaaagcagcgtggcaagctcaccggacagcatccgtgagttggagccgctgataaagagctcgtactcctcggtatagtcctgcgaataagaattgaccgacttttcccattcttggatgagctgcacttcgtcgatgaaaatatacatcctttcctgagggtgcagttcgcttttataaagcgccaccaactcttccaaatccttgtgagtcttcaagaaagcaaagtcgctcagttcccggttgatgaacaaggtgttctgcggagggacaccgtttcttatcagttcccttgctatctgtctcaacacataactttttccggtacgccgctgaccgataagcacctttacaagacgattacctacgtagtccatgattctgccggtataagctacccgcatgaaaccaaagtcaaaatctccttctgtccagagattgtacttcctaagtatatccattctttcgtccataacctaaactttagttgcaaagataacaattttcggttataaacgaatatttctatcaactctttcgttcataacctaaaaaatttgcgaaaaaggctagattttcggttataaacgaaagattcatttagacaagcaaggaggatatttcctttccgcatccccctttatcggccggatattccctctatagaatcatcattgttgcatctatacttccaccgcgctgcatctatacttccaccgtgctgcatctatagatgcagcaaatcccttaacctatcctaataatgctgcttattgtcacctatttagaagcgaaatcattatatttgcgcccatatatgccaatacgttgactaagcgatggcaaaacagcttgtaaaaaacaaaactgaataataacgaatttcatccgaatgaaacagtacaaaaccgtaaacaaccttgtaggctggattaccttcctcattgcagcgacggtctactgcatgaccatcgaacctactgcaagcttttgggactgcccggagttcatcaccaccggctataagctggaagtaggacacccgcccggcgcaccgttcttcatgctggtagccaacctattctcacaatttgcttccgatgcctccaccgttgccaagatggtgaactacatgagcgcgctgatgagcggcgcatgtatcctgttccttttctggagcatcacgcacctggtacgcaaacttgtggtgacagacgaaaacaatatcacacgcggccagatggttaccatcatgggtagcggtctggtgggcgcacttgcctacacgttcagcgataccttctggttcagcgctgtggaaggcgaggtgtatgccttctcctcactgttcactgccgtcgtattctggctcatactgaaatgggaggacgttgccaacgagcctcacagtgaccgctggctgattcttatcgcctacctgacgggactttccatcggcgtgcacttgctgaacctgctctgcctgcccgccatcgtactggtatactactacaagaaagtacccaacgccaatgcccgaggttccctgctggcattgctcgcttcgggcatactggtagcagccgtactctacggcatcgtgccgggtatcgtgaaagtgggcggctggttcgaactgctcttcgtcaacacgctgggcatgtccttcaacacgggtgtcatcgtatatatcatcctgttggcagcctgcctcatctggggtatctacgaaagctataccgaacgcaacaaggcacgtatggcactctcgttcatactcaccatcgccatgctgggtatcccgttctacggacacggcaccagctcggtggttatcggtatcatcgtcattgccgcattgtggctctacctccgtccgaagacgcaggcagccgtcaaagagaaattccgcgtatcggcacgcacgctgaacacctcgctgctctgcaccatgatgattgtcatcggatattcctcgtatgcacttatcgtcatccgctccaccgccaacacgccgatggaccagaactctccggaggacatcttcacactgggcgaatacctgggacgcgagcagtatggcacacgcccgttgttctatggccctgccttttcctcgcaagtggcgctggacgtgaaagacggttactgcgaaccgcgcatcaagtacaacggcacgaagttcatccgcaaggagaaagctacgcccgacgaaaaggattcgtacatcgaaatccccggacgcattgagtacgaatacgcccagaacatgctgttcccgcgtatgtacagcagtgcccatacacaacaataccatgcctggcaggacatcaagggttacgatgtgccctatgacaaatgcggcaacatgattatggtaaacatgcccacacagtgggaaaacatcaagttcttcttctcctaccagctcaactggatgtactggcgctacttcatgtggaacttcgccggacgccagaacgacatacaaggcagcggagaaattgaacacggcaactggattaccggtatcccgttcattgacaactggctggtgggcgaccagagcctcttgcctcaggaactgaaagacaacaagggacacaacgtattctactgcctgcccctgctgctgggtatcatcggcctgctatggcaagcctaccgtgggcagaaaggcatccagcaattctgggtggtcttcttcctcttcttcatgaccggtattgccatcgtgctctacctgaaccagactccgagccaaccgcgcgaacgtgactatgcctacgccggttcgttctacgccttcgccatctggattggtatgggtgtggcaggactcgtccgtctgcttcaagactatgccaagatgaaggaactgcctgctgccgccatcgtttccgtagcctgcctctttgtccccgtgcagatggcaagccagacttgggacgaccacgaccgcagcgaccgctacatggcacgcgacttcggccagaactacctgatgtccctacaagaaagcggcaacccgattatctataccaacggtgacaacgataccttccccctctggtacaaccaggagaccgaaggtttccgtaccgacgcccgcacctgcaacctctcgtacctgcagaccgattggtacatcgaccagatgaagcgccccgcctacgacagtccttctctccccatcacgtgggaccgaatggagtacgtagaaggcaccaacgaatacgtccccatccagcctgagtacaagaaaagcatcgaccagctctatgccgaagccgagaagcaggcactggacggtaatcccgaagcactggtcaatgtaaagaaagaattcggtgacaacccgtatgagctaaagaatatcctcaagaactgggtgcgcaacaagaatcaggacttgaaggtgattcctaccgacagcattgtcatcaaggtagacaaggaagccgtgcgccgcagcggcatgatgataccgggcgactcaatccccgactacatgcacatttcgctgaaaggcaaacgcgccctctacaagagcgagttgatgatgctcgaaatgctgagcgaggccaactgggaacgccccatctatatcgctgtcagcgtaggcagggagaaccagctgaacatggagaaccacttcgttcaggaaggtcttgcctatcgtttcactccgttcgacaccagtaagacgggcgtgacaatagactccgaaaagatgtacgacaacctgatgaacaagttcaagttcggtggcatcgacaagccgggcatctatatcgacgagaacgccatgcgcatgtgtcactctcaccgtcgcatcttctcccaactcgtgcagcagctgatgcgtgagggcaagaaagacaaggcaaaagccgccctggactatgccgaaaagatgattcccgcctacaacgtgccttacgactggcagaacggtgccgtacagatggcggaagcctactaccaactgggcgaaaccgccaaggcggacgagatgatgaaagcccttgctgacaaggctgtagagtacctgacctggtatctgagcctggacgacaaccgcttcatgatttctacccgtgaatttgaataccactgggctgtactcgatgccgaggtgaaggccatgaagaagtacaactccaagctcgccgaaatctacgagccgaaggtggaagaactgtataatatgtatgtggacagaatgaaggagtgagaataaggattagggattaaggattaaaggattagggattagcctgtgcagttcatcactaatcattaataactaatccttaacccctaatccttaacccctaatccctaatccttaatccctaattaatcattaatcacgtgtttatagaacaacctcctgagttttttcgcaaactatatcccggtgcagtctggaggatggaccccaatgaaaaagccgtttatctgactttcgacgatggccctatccccgaagtaactccctgggtgctcgacctgctggataagcacaacatcaaagccaccttcttcatggtaggtgacaacatacggaagcatccggacgaattccggatggtcgttgagcgtgggcaccgcatcggtaaccacaccttcaaccatatccgtggatttgaatacacggccaagaattatctgggaaataccgaacaggcgaagattttcatggaaatgggtggggacatcaattgcaatgtggagaaggttctctaccctctcttgttccgccctccccacggccatatgttcgccaaccagtatctcacgctgaaacgaacctacaagattgtgatgtgggacctcgtgacccgcgactacagcaagaagctgcgcggtccgcaagtgcttgccaacgtgatgcgctacgcccgcaacggctccatcatcaccttccacgattccctgaaatcctggtgcaacggaaacctgcagtacgcattgccgcgcgccattgacttcctgaaggaagagggatatgaattcaaagtattataaacttgaaacagcagaaagttaccaacatctgctgtcacaataaattccacataaaataagaaggggttgtctcggcaaaaggcaaccccttacattttataggctcatgtcctgttccacaagaataaacagatgttttataattaccaagtaaatgtacatctgtattcatcccactggtcttttacaaccagttccgtaggataactgtcggaattcaatgtccatgtaaaatacatatcggacacagagtcctcgccattgtatgtataatgccctacaagcggcagatgtttcgtagccttaccaagcatgcctccataataggcatatatcatctcgtccatatccacatccagtatttcatcaaacaacatcaggcagcccttattctcgataggagctgttatattatccgtcgtatagtctatggcagcactatactcccactcgtcattgctgtcgataattccgtcaccattgagatccccactagctacataacgtgtggaagtcttcaccacatctccatccttataggtgatgttcgttatttcaccatcgctttcagagcgtttcattacaaccagatggccttcagtgtcgtattccatctcccaagtaaactcatcggcatcgggagtaccagcgtggtctattgagttgcaaaattccacataaccatcgctgttgagctgcaagttcagttctgtaacatcgccctcttcatccgtcacggtgattcttgctcggtcctttgcaacatctgcctttgtagtagcgggaaagtactcaaagacggctttatccccatcctcagttgtaatgttcgtcaccagcccttcttcattgtgagaaatcgccatgcccgaaaccgacttcggaagccctcccgtaaacacttgcgaaggattgaccacagtggcggtgttttcgccaccctcaccattctcattttcgtcatcgtcactgcaagcagtgaatcccaagcacaacgccacacccaacatggaggcagccatcattttaaacattttcataagttacaaatcttgttttatccccatccctctaaggaaaatccataataacaaaagtataaggaatgccgtccgtatctcacgacaacaagactctgccattcaaacccggacagatacttttggccatttatcattcccagacaaagcttaatattttttgcaaagtaataaacttttcctttcactccttgtcactgaaaaaggtgatttttcagccacatacagaaaaaattcagcatctccaataaaaagcaaaatgaataagacgtatatttgcaacaactaagcacagattgaattccactaaaatataccgatatgagggtacgtcatactaagctattatcactcctcttttctttaaccactatcctgcttcacgccggagaaataccaacagacactctgttggcacacttctacaaccgggcagccaatctcatggaagaaggacactacgatgaagcgcaacgtagcttcgacagcgcctttgccacccggaacgtaaagcactccttcatgtatcccatcttgctgaacgaacaagccacactgctggtctatgtgggaaagacagaagaagcctttgccatgaaaaaaaatgtgctcccctacctgccgcagatagatgatttggaaaagcacatcagcgtatacaacgatttgggcctcctctaccgtcagcaccaaatgaatgactctacactctactattacaataaagcactggacactgccttgcaatacggagacgaaagctggatagcccacatctgcaacaatgtgtccatcctatacttcaatatcaggcagctggacgaagccgaaaagtataccgacatggccgccgaacatgccgccagaaccgaagacccattcgtagccttcaccacctggcaaatcagggcaaccataaaggctgaactgaacaagctggatgatgctgaaaaatccaaccgcaaagcctggaacattgcctgccacggagagggaaacgaagacctatggaagatacgctgcctgcccggcatgctgagactctttgaacgaaaagaacaacccgattccatagaccactacttgaaattggggaacaaactactacaacgggtaccatccaactccatcgctgccataggattcatacaatcgagggcagccaccgaaacaaaccgcaaaaactatgcccgcgccttgaaggacttccactggctgcgtaaccggaaaaccggtaccgagcccaaaacattatttacacaaatggcacgatgctacgatgccttgggaaaccccaaactggcctacacctatatggatagtgcccgcatgtggactgatacgctggcacagcacaatctgacgcaacaaatggcagaattcaacgtgaaatatcacacacaagaaaaggaattggagatagcccacctgcaacaagaacaactggaacaccaagccttcctgctaaaagcctccattgctgtagcccttctgtccggtcttgctctcattactttgttgacgctccgccacaagaaacgaatagccgaaaagaagattgaactgctaaagcaagaaaacgaactgaactcggcacgccgttacattgaagggttggaagaggaatgcaaatattttgccaaggaactgcatgacggcatagccaacgacctgctggggctgcaaatgaagatagaaacttctgccagcaaagggaatgagcaggaactggcctcactcgtcagcaaactgagaaacaacgtgcggaatatctcacacgaactgatgcctcccgaattcgagcatctcagtctagaccagatactcgaccgttatgctgccaaactgaccgagaacaccggcatagaggtcagctatcatccaacggagaacaacgcatcacgccatcttcccaatgaaaccgcttatgagctgtaccgcatcgtacaagagctcaccatgaacatcgtgaaacatgcctcagccagtcatatagtcatcagtctccgtgccgacaatgaaaataaatataccctgcaaattacagacaacggtaagaatgcaaacaagcaacaaacagcaacaaacaacaatgacggcataggattgcgcaccgtaaacgaccgtatcagagccatcaacgctaccgccaatgtatgctcgtcaacagaaaacaacgttttcaccctactgcttaacataaacgaatgaaaccaaacaaagaaacatacagaatactggtaatagatgaccacccgattgttgctgaaggcatcatcgcattggcctcgcaactcgaaggagtgacgtgcaaaggagccacttgtgcaaaagacgtggaacaactgaccctcaaagagagattcgacctttgcatcattgaccttgaactaccggatatgaatggattccaactcatatcccaccttcacagccagatacccgaatgcggcattttaatctataccatgcatgaagaaccttggatcatagccaaattatccaccctaaacatcaacggagctgtttcaaaaaatgccagcaccagcgaattgagagacgccatcagtacactgaaaaacggaaccagatacttcagcaatgttttcagcgaactggacaaggaaaaacaaaacaccctaccacatgcacttcccgaattgtcgagacgtgaaaaagaagtgctcgcctatctctcgcaaggactgagcacttctgaaatatcccaattactatttctcagcatcaatacaatacagacttaccggaagcgcctgatggaaaaactggaggccaaaaacgttgcagaacttgtctacaaggggaagagcttattctgagaacacttgtcattcgcccggacagttacaagcctccagcttctcaagcttcgctttcggaaaaggaggaaaatcaacttaacggatactcaccgtcatcggattgcgtaccttctgtgcaaatgccgccatatagctattccaggcttcagccgtcttgatgtccgcacggtcccaggcaaaaccccagtaatacacgtagtcggcacccggctcatagtcgctgacagccagtacgtggccgtctgcattgttacgcatcttcttctcctctacggggaaaagcacggttttggcttccttcacaacggcagggaaagcggcacccataaatatcttgccattatccggtccggtagtggggtctacatacgtcatatagccaccggcggcatcagccaccacagcaccgtccggttcgtgcagcacaataccggtaacaatgggcaaagattcctttagattgctatacgaaacggcagtacggttcagatgagaaccggcatccagcgtaatcagacgcgtttccaccaccgcagtatcccctttcacagccaacggattgaactccagcttcaccgtgaagcgcaacggaccgttgtccagcacctcctgcgtcttgtagcaccacggatagataatggtatcattcaccatcaatgcagacactccggctcccaatgttgggcctactgcatagcagtccatgccataaccgtggtctatatgataggagaatgtgcgtaccagctcatcggctgccttcgggtctgtcttgcgcaattcattaacctgcttccaggagtctgcatccagttccttggcatacatgtcttccaataccggtgcagcagtgcctcgcttcgtgaacaagtcgtagccgaaaccgcgttcacccctttcctgcaatgcaggaccgtaggcacggaagcctaccaagtcgttctcccaggccatgtcgtccagacgttcgggatactgccgcccacaagcccttacctccacatcgacgggagtaccggcctggacggtatatgcagccgatgcattggcggctaccgtagcagggaagattaatttgtcatcgtaggtcacttggtagggaacctgctccccttcgacattcagaaccacaatctgtgcggtatctgccagattcagacggttcgagatttcggtcatagacacctctaccatctcatcggaacggtccatcatcagcggattggttaccgtaacggtcactgtcttgctatcgttgcaagcaagacagcagagggtcgccatatacaataaaagaaagtttctcatataatcattgctttttcctaatcagttgtataactttcttttaggcacggatttcgcggattatacggattttccttatcttttccgcgtaatccgtgcccaaaagaaaaaggtgacagtgacattatcctgccactttatcaccttctcaattatccttcaaatttatttcggttgctttccgatataagccaagatacctccgtctacatagaggatgtgaccgtttaccgcattagaggcttccgatgccaggaacactgccggaccggtaagttcttccggagccagccagcggcctgccggagtcttggcgcagatgaacgagtcgaacgggtgacggctaccgtcggcctgcttttcacgcagcggagcagtctgcggggtagcgatgtaacccggaccgataccgttacattggatgttatattcaccatattcagagcagatgttgcgagtcagcatcttcaagccacccttggcagcggcataggccgacacagtctcacgccccagttcggacatcatagagcagatattgataattttaccgtggcccttcttcatcatggcaggcagaacagcctttgatacgatgaacggagcattgaggtcgatatcgattacacgacggaagtcagcagcctccatctcgtgcataggaacacggcggatgatgccggcattgtttacgaggatatcaacagagcctacttccttttcaatctgggctaccatggcctgaacagcaggttcatctgtcacatcacatacataaccgcgtgccttgatacccttttcagtataggcagccaagcctttgtctaccaactcctggttgatatcgttgaaacagatagttgctccttgctctgcaaaagctgaagcgatagcaaaaccgataccataagaagcacctgtaacaagggctactttaccttccaaagaaaaattcaaatacggattcataacgttaaattattaagtttaaataagtgatattctatttatgtacgatttgcaagtagtttatactcaatggaaactttattttgggagaatgccttccctataaggaaatcgcagcgaatgcttttcgtatcgtagcttttcacatcatcgggatgctcagcatagcgaatttcatagttcgttttcatgattgcactacatttaataggttataacttcagccatcaaatacacatcgtttgcgtacacgatgcaaatgtaacaaaagaaaatggagaaaccgtataaatttgtgtcaattatatagcaatatcgttcaaagattcgtaaaaagaaaaaatctatacctatagtgccaacaagagggggaaagaataacaaaaaaacccactaaaacttgcgattttagtgggtttttagctgcaattagctgcatcgtagttggactaccaggattcgaacctggacaaacagaaccaaaacctgttgtgctaccattacaccatagtccaaacatagggctttctgttaaaaagcggtgcaaagataaaaggaagccccgaaatatccaaatatttcggggctatttttactgccgaagcattatttccttaattacttctctttaggataccgctatttggcgataatcagatagtaattcttcttgccgcgctgtaccagcaggtatttttcgtccagcaggtcggctgtcgtaatcacctggtcgaaagcagccagtttctccttattcagagaaacgccaccgccttgcaccagcttacgcatctcgcccttggaagcgaatacagcagcattatccacgaacaaatccaccgccttcacaccggcagccagtgcatcacgggatatttcgaactggggaacaccctcgaacacagccagcagcgtatcttcgtccaacttcttcagtgcatcagaagttgcattgccaaacaagatgttggatgcatccacagcagcattatagtcctcttcggagtgaaccatgatagtcacttccttggccagacacttctgaaggacgcgcaaatggggagcagcctcgtgctcggccgttagagcgtcaatctcctccttggacagtgcagtgaatatctttatgtagcgtttggcatcctcgtcgctcacgttcagccagaactggtagaacttatatggagaagtgtagcgcgggtcgagccagatgtttccggactctgtcttgccgaacttgccaccgtcggccttcgtaatcagcgggctggtcagtgcaaacacctccccgccgttcgtacggcgaatcagctcggcaccggtagtgatgttaccccactgatcgctgccacccatctggagcttgcagcctttggtttcatacagatgaaggaagtcgtatccctgcaacagttggtaggtgaattccgtgaaggaaagaccgtcacgtgcctcaccgttcagacgcttctttacagaatctttcgccatcatatagttcacggtgatgtgcttacccacttcacgggcaaaatcgaggaaagtgaagttcttcatccaatcgtagttgttcaccaactcggcacggttgggggcatccgaatcaaaatccaggaacttggagagctgggccttcataccggccagattgcgctgcaacgtctcttccgtaagcagattgcgttctgcagactttccggaagggtcaccaatcatacccgtagcaccgccaatcagtgccaacggcttgtgtccgcaacgctggaagtgacgcaaaatcatcacactgcaaaggtgcccgatgtgcaaagagtccgcagtagggtcgaaaccaatgtatgcagtcacttgttccttagccagaagttcttccgtacccggcatcatatcgtggagcatgccacgccatcttaattcttctacaaaattcatcgaatgattaagttatctgattaattatttaagtgattatctatgaattgtttgattcctattttaatctgcgcaaaaatacgactctttattcgaagaaacaactcttagggtttaaaaaagactttgcagacatttctccggagtgtttctccaagctcctcgggagagatgccgcgcacttcggcagcgcgtgcatacaattccccgatggaaacttcactttcatccgtttcgatgaacagccggtcggcaggtacccggcacaaggctgcttcctggtatttctccccgaatgaaagataaaagccatgtttcagatattcctccgccagcgccgccttgccacggaaaccatgtattatccacggattcgacgggcgcaagtcccgcttcaccttcagcagttcatcaaccgccttcaccagatgaatcaccagcggctttcccacttcctctgccaaacatgcctggtgtctgaacacttccacctgcaaatccatcggagcatctgccagcttgtccagcccggcttcgcccacggcaagtacttggggatgacgcactaactcctccaggccgcacaccctgctagccacagcaccttcaactccagagtgttcacctccactccgacctatatgccagggatgtatccccaccgaataccatccgccgctctgtggagagaacgtttcgggatagcaatttgcaatggcagttccgggtacttgcggaaaccggtgtgtatgtatgtctactggaatattcatggaacgggatcatatccggaacctccccagggatggcagcgcagaatgcgccttactgccagacaaaaccccttgaaaggtccgtgtttcttgatggcctccaccgcatattgcgaacaagtgggggtaaaacggcatgaaggccctatcatgggcgatatgcacttctgatagaaatagatgggaagcagcagcagatatgaaagcagacgcttcatgacacctgcggagtttgctcggcttcagcatttgccgctaccttctcgacaatgcgtgccaaagctgtcttcatacggtcctcaatgacagaagagtctaccaactggtccgaaagatagataaaggccacggccagacggcactttttttccgtcagcacggccagcagtccgtgtttgttcatgcggtaggcttcacgtatctggcgtttcacgcggttgcgcttcaccgcccgcttgaaacggcgtttcgaaacacttacaagaatggaaacgggtgcctccagctcctccaccggcagatacaccacacgcaaagggaaaaccgaaaacgagcgtgagccgcccgcaaacatcttctctatcactttcttcttgtccaaccgttcggacttacgcaaggtatttggcatgagaaacaaggattagggattagggattagggataaaggattagggataaagaataaaggaggtggaggtgaataggttcgtaaccattctattttccgccacgacaattttatcggctgtttttcagccgataagtgtagatggtgattttacattaccaaacgtaccaagttccgcgaaaactctggtgatttcgtttgttggtatgcaaacccaagaagtaacgattaaacctcatgtaaaggtaattttgaaatccgattctgagctgcttgaagaggttgtggttaccggttacggtacatttaaaaaagcatcatttaccggagctgcttctactgtaaacacttccaccttggaagatgtacctgttctttctgttgccgacaagctttctggtaatgtcgctggtgttacttttggttcaagttcaagtaatccaggttctgtaagcagtattcgtgtacgtggtatgggttccatcaatgccggaaacaatccgctttatgttattgacggaacaccggtaacaagtggagacttatccgagttcacttatagtgatgcaggaactgatattctgtcttcactcaataccaatgacatcgagtctatcacagttatcaaagatgcggcggctgcctctctttacggctcgcgtgctgctaacggtgttgtggtcattacgacgaaaagcggaaaacaaggtaaaacaaatgtaagtttccgctctgactggggtttttcaaacatggcaatagattatcgtcctatgctcgacggtgactcacgccgcgaactcttatggaccggtctcaagaattatggattatacagcggaaacatgtccgatgcagatgccgcaacttttgcagaccagaacatcgaggacttcgcttcaaaaccctcaaccggatggacggattggaaagacctgcttttccgtaacggttctcatcagaactaccagctgagcgtatctggcggcaacgaccgtaccaaattctacacctcagccgcttataccaatcaggaaggcatcatttacaaacaaggtctggaacgtttcactggtaatgcaaacctcactcataagtttggagactttgaagttcaggttacaagccaattttcaaaagtaagacaaaacaaaaccaatgaagctacctcctatgatgggcctgtagccaattatgcattcttccaaagcccctcatcaactccctataatgaagacggcacattaaacaatggttgcggcatatttggagtcaatcctttgtatgaaagagagcacagctctgacgtttataccctgatgaaggcatttaatacaatcaagttgacctataatatttgggacaagttaaatttaagtgaaaagattgcttatgattacgcacaaggtaccaatgatgttctttgggacagacactcaaacaatggcgctccaggtggtgtcatgcagcgcattgtcaatcgtaatgaccagctgaatacacaaacccagctctcttacatcaactctttcggcctgcacaatattgatgccctgcttggttttgaaacacaagatacggaatatgctttcaactatatggcaggccaagactatccgggtgatttgtacgaattgacaaatgccggttcaacaagtgccgaaaccaacagacagagctatcgcatgacttcgttcctcggacgtgccaattataactacgcagacagatattatctcggtctcagctatcgtaccgacggaagttcacgtctggcaagagaaaaccgttggggaagtttctggtcggtttccggagcatggagattcatagacgaaagttttctgaatcccgtcaagagtgtattgacagatggaaagctccgtgtgtcatatggtgtaaacggaacgcaaccatcagactattacgcttatatgaatctttataaatatggagtcatatacaatggacagtcaggaatgtcaatcgtcggaattgcaaacccggacctgaaatgggaaaagaacaaaacatggaatatcggtctcgacttttcattcattgaccgtatctccgtaacattcgactactatcagcgtaaaaccagtgaccttatatacgacctccccgtatcacaagtcggaggatattatgatggcgattacggatataccactccgcagaacatcggttcactgaagaactccggttttgagttgaccattacatcaaccaatttcagaaacaaggatttcacatggaccacttctctgaacatggcacataacagcaacaaactgaccaaactggatggccagcagaatgaaatcgtatcaggaccactgattcaccgtgtaggcgaaccttactattcatactatgtttatgaatacgccggagtcgacgctgagaccggtaaagaaatgttctacctgaatgacggaacagagaatgcccgcaagacaacaaccaatatctctgaagccaacaaaactattgtaggcaagcatcaggctagtatagaaggcggtcttaccaacaacctcaaatggaagtttattgacttgggcttcactttcacttattcattgggtggtgatgcttttgactactccacttggcagcactccaatggcggttcacatctatacgatggtgccgtaccgacatactacgacatctcaaagatgtggaccggcccgggcgacacgaatgccacattgcctaaatttgaatatggaagcgtagcttcactgtcttcacgctggctgatgcctactgattatctacgtctgaagaacctcacattaggtgtaagcattccgcaaaactatatcagcaagcttgggctcagcaaagccagaatctacttctctggttccaacctgcttacatggaagtctaaagacttatttgtagatccggaaatgcgtgtagacggactatgcacatttgagactccggcattgagaacatatacattcggaatagaattgaatttctaactaataaagatacgaaaatgaaaatattaaagacattatacacagcaacgctttgcgcagctatggcagtcagcacttcatcatgcctcaacagttggctggatcagtcacccgcagacggaatagatgctgaaaccgcaatcaagaacagcgatgatttggccaatgtgcggacgggactttatgctgccgttaaaggtaacagtagcctaattaattattatggacgcctcatgttcgtatacggtgacatgagaggggaagatatccaatatgaatataacggtggaagtggaagagcaaacttctactactatatggaatatacaactgccgacaatttcaccacctcaacagccgtatggcagatgccttatgtagtcatagcacgcgccaaccgtctgattcaggcagcagaaagtggcaacctgaccgacgcggcagaggcaaaagccactattgaccaatatgatgcagaagcaaaagttctgcgtgccatggcactgtttgaccttacacgtatctacggtaaaccttatacggtagatcaaggcagctcactcggtgtgcccatcgctacctccccgctggaatcgacagaaaagccaagccgcagcacggtagcccaatgttatgaggctattgaaaaggatttgacagatgcaatcaactcaaatgcactgcccaaaaccaatgaagtgggttatgtcaacctttgggctgccaaagccttgcaggtacgtgtatatatgacaaaaggcgaatggagcaaggctttatccgtagctgaagacatcatatcaaactcgtcttacaaactttgggaaccgtcagaatatgttgctgcatggagcaaaagtgatgccaatcattcaaaagaaatcatgttcgagatttccatcaacaacaatactgactggacagaccgtgaaggtattgcctacttatatgcagacaaggctggcgcttctcccggatatggagatgtaattgtcacaaaagacttctctgacatgcttacatccgacccggcagacatccgtaacgacatattattggcagcggcagcaggaggatttgacaaacgtaaagtttacatcaacaaaatgcctgctgtaaacggagatgtacgttactccaatgtcccattgctgcgcttgtcagaagtttacttgtcagcagcagaagcagctttccaagccggagacaagaacaaggctgccaacttgctgaacgatatcatctccaaccgcacaacggatgaaagcaaacaagtaaccagcggaaacatcacattagaccgcatctacatcgaacgccgcaaggaacttgtaggtgaaggacagcgctacttcgatgttatgcgccgaggtgaaaccgttacacgctacacggacgttaatgacagaggatggcacgacgtattgagcgaagaagcgcgtacattcaaccgcgactccaagaaagcgctcccgttgattcccgtcggtgaaatcaatgccaatccgaacatagaacaaaatccaggctattaatcaatagtagcctaaagaaacttgggaattttcccaatgtgtttttataaataaagtgtttagaggaggtgtgccagtgatggtatgcctccttctttcaatatatccaccaatataggtttcactccgctgacaaaacactcaacggcaataaccatcaggataagtcccattaggcgcatcatcacattgtttcccgtctcacccaaaattttgaccaaccgcgtggaagcacgcaatatgaaaaaggtaatcagataaataaaggcaatcattcctataagaactcctttcatctgaatggtgtgggcatcctgcatcagcacaatggcattggctatggcaccaggaccacaaagcatcggaattccaagaggagtaatggaaatatcatcggcataagtcttgatttcctcgtctttcagcttcattggggtataacgggcttgcagcatatcgaagccaatcttaaagataataactccaccggcaatacggaaaccattggtagagataccgaagaacttaaagaggaactgtcccgcaaacgtaaaaaccataatcgtaataaaggcaaccaaagtggcgcgcgatactaccgactgccgttcacggtctgtcattccatgcgtcatggtcaaaaacaccggcatggtgccgagagggtttgtcaacgtaaagaaggaggtaaaacaaagtaaagcgaaaggtaagattgtgtccatagctgtataatatacgtttctgcagacaaaagtacaactaaaaatttcaatgtcacaaaatctgcatcaattctttcagattactgatatgataagtcggttggaaaggcagttcttccttccctgttacattataaaacacttggtgcatgcccactcctttggctcctgccacatcattctcccaactatcgcctatcatcaaagaatcacgcacttcggattgtgtggcagaaagtgcaaaatgaaagatttcgggccagggcttcaagacaccgatgtcatcagagagaacaatcttcttaaaaaagcggtcgatacccgccgaacgcatcttatgacattgcagttcttggaaaccattggaaaggatatagaggttatatttccccgccaaatattccagcacctcataagcatgcggcatcagccgattttttgtgggaatgaccgaaaagaaatcatcagaaaaagcctcagccaaagcaacatccctcgcccctactgcctccagaggatataggaaacgctggcggttcaactcttccttactgacctgccctctaccgtattcttcccacagctctgtattacgatgctgataaagagtatagaaatgcaggaaagagcgaaagaaacgaccatagtcatacttgtgatacatttcttcgaatgtatcacgtgcattaagggaaaatgcccaaagcgtatcgtccagatcaaaaaagaggtttttatattgagatgccattacttaaaggaaaggtatatataaaaatagacgcagattatcaattccaataacctgcgtccgttctgtatcaatcttataacagtgttattttacttggattaccaaatacttggacacactccagaagtctttcggatttgtaatcttcaaagtcagctgtcctttatcatctttctccaacgcataagagccagcaggatgagtggtcaagatatcagcatctttggagtatagtttaatctcttttgtcgtacggatatccacttgtgtaaagtagtccttgttgatatcagaatctttcagcacctggccttttttgaaaagcccggtatttgtcaatatcttctggtctttcagctccttctttgtgccaaacacaaaccaagctgtgttaagtgccttatcttgctcggcaacggttttggccttcgcctcattttcggcagtcaattcctccttctcactagacaagccggtcacggcagcatccagttcctggatacggatattcttggaagccagctcagcctgcaattcttcaatacgctgggtctttgccaccaactcctgagtcaaagattctacagctctcttcaactgaacagagttgtttttgctgttcttcaacatagattgcagtttggcaatctgctccttgttctcttccatctgtttacggataaattcaatgtccgacgcaatctgctgcttggcattcaaagagccttctgccacagcgccacgttgcaaatccacacggctctccgccgcattaatctggcggaatccctctgaaatatcattgaaagtacccatcatctcgtctaattcagcattacgctgagtcagttccatcaataaagaatcattttcagctttcagctggttcttactgccaccagagaaactgtcacacgaagccattacagccgcgcatacaattaaaactgctaactttttcatacgctttcgttttacgtttggttaatgaagttatttaatcgtctattcctgctactacaatcacaatttcaccgcgcggttcgttcgccgtgaaatgttctattaattctgtaagcgttccacgcaccgtttcttcgtgcacctttgaaatttcccgcgaaacagatgcctgacgtccggcaccgaaatgttcggtaaactgcgccaaagcttttaccaatctgtggggagactcatagaacaccatggtacgacgctccccggccaatgccttcaggcgagtcatccttcctttcttctgtggaagaaaaccttcaaaacagaacttctcattcggcaatccggaagccactaatgccggcacaaaagctgtcgctcccggcaggcattgcacttcgatgccgttgcgcacacactctctgaccaccagaaagcccgggtcggatatacccggtgtacctgcatccgaaatcaaagctacagtttctcccccctttattctattaacaacactttcaaccgttttatgttcattaaatttatggtgagattgcatcacattctttatttcgaagtgtttcagcaatatgccggaagtacgtgtatcctcagccaatattaaatccacttctttcagaatccggatagcacggaatgtcatatcttccaaattccctaccggggtaggcactacataaagttttcccatacttatcggttgtttagctgaaatattttttgaggagttccataaaatcgacagcggcttcattctcttcatccggctgcacttccgaaacgaaaatatccatagccttgtccaaagaaggggcctcacccaaacgtcgtaccacttcattcatccgtgcagcatcgcctgcgaacagctcgcggacaaaacggaatgaatcgttcagactgatggcatgtctcaaatccttggcaggcttgatacgttctgccaaaataggagatgccgaagttacaacagtctggagcgcttcagccgtatgaactgtttccggttcctcacataccatcttcattgtatcagggacgaccggtacaaccggagaaaccggtccagccaaaggagtagtagcagtagggatgtccttcaggggcggcacaacagccgttggcgcctcctcaagcagttcttgcaacgcctccaagcgtaccttcatctgctggatattccgttttgccacaatcctcaatgtcggattggtatcacttgaaatggcttgcatcaaacatttcaattcctgaatatctaattctatgtcatttaataaggtttgcatatcctttacacagtccgtgttaacgctacaaatgtagaaataaataatgaaaaaatatcggaaagcaaacaaaagtgttacttttgcgcttaaatataacactcgaaagcatggtattattctcagaagatcatatacaggaaaccaaacgcaggggaagaattgaggtcatttgcggttctatgttttccggcaaaaccgaagagctgataaggagactgaaacgggcaaaatttgccaaacaacgcgtagagatattcaagcccgccatagacacccgttattccgaagccgatgtagtatcgcatgacagtcattccatagcctccactcccatcgactcgtctgccagcattctgctcttcacttcagagatagatgtagtgggcattgacgaagcccagttctttgatagcggcctgattgatgtatgcaaccagcttgccaacaatggtatacgcgtcattgttgccggactggacatggacttccggggtattccattcggtcctatgccgggactgtgtgccattgcagacgaagtttccaaagtacatgccatctgtgtgaaatgcggccaactcgcctcgttctcccaccgtaccgtcaagaacgacaaacaagtactgctgggggaaaccgaagagtacgaacctctatgccgggagtgctatcagcaagccatccaagccgaccaaaaggaaagcggtcattaacgaatacaaaaaacagagcattatggaacgcaaaaagattacattcgacagttttatccgcggtgtcatactcggtgtcattattatcggcatccttatgctcttcaagcgtctaagcggcgtattgctgccattcttcatcgcatggctcattgcctatctgatataccccctggtcacctttttccagtacagattaaggctcaagaaccgggtcatatccatcttctgcgccttattcagtattctgattgtaggaggaaccgcattttatctgcttgtgcctcccatgatggacgaattcgtcagggtgaaagatttggtaatagactacttttccaacggaacccacgacggcaatgtgcccaaaacactctctgaattccttcgtgagaacatagacacccagtttgtcacccaattgttcaaggaagagaatatgctgaacgccatcaaggaaaccgttccccggctctggtccttgctgtcagaatccgtcaatctactgttcagcttcttcactttctttctcattcttctctatataatcttcatattgctggactatgaaagcatttccgaagggtggccccacctggtaccacagaaataccggcccttcgtaatcaatgtaatgaacgatgtgaaagacggcatgaacagatacttccgcggacaagcattcgtggcattgtgtgtcggtattctgttcagtataggctttctgattattgatttcccactggccattgggctcggcttgttcatcggtgctttaaacctagtgccctatttacagattattggctttatacctaccatcgtgctggccatactgaaagcagcggatacgggaggaaacttctggattatcattgcatcggcccttgcggtattcatcatagtacaagccattcaagacggattcatcgtaccgcgtgtcatggggaaaattacgggcctgaaccctgccatcatcctactgtctttatcaatttggggctcattgatgggtatgctgggtatgattatagcacttccgcttaccacccttatgctctcctactatcaacgtttcatcataaacagagaaaaaattcacaagtttgaacagactgataatcaacaagaagagtaaaagcagaagtcgttatcaaaactttttcccttaatccatttgttttttaaacaaaagtatctatctttgcacccgcttaacagcaataaggtctgaatcgctagctcagcaggtagagcacaacacttttaatgttggggtcttgggttcgagccccaagcggttcaccaaagaaaagcagttatctgaaatagataattgcttttttcttttaaaggcatctgctacgtaatgagttggttggaaagtttataatcataccgatacttcagaacacaaaacagaagcacaatgaaaatgattggttttacccagtcatcttatccggtatttttacgcccctccgatgaggattacaaaactcttttggttttctaattcgcgtgcaaaagagaaacttatttttcaagtatcccaatattcatgatttctttcactgaaaaactgtaagacatgaacattatccactgccatatcactcttttgaaggtacatacacagccaatgaaagactatttatcagtttttcatcactcaaatataggtttttagtccactgagtaaatgacagttagatatgcgcactattgtggtactgcttctccacaagcatgaagaagccgtaccacaatagtgaagaaactgcatcacaaccgtgcacaatagtcattaataagcttttagtagaagaaagagccgttctttgcggaaagaagaccagccatttgcacaagaaaaaacagcatgcaagcaaagtttgcctacatacttgcatagcgtctgcttacataccgtaaaacgcggtataacaaacaattagaaagcgccatgcaagcatgtaagcaaaatgtgtggtaaacctattgtatatcttttcattttgcgacgactccatagtaaaccatgttatcaatacgcttctgataaatctggttattctgcagcagataccccaaggccaaacacaaatccacatccctgaacttcgtcagtttctgtaattcaaagattgtacacttcttaagattgcacagaatggaatataccattttcatattattggtcgccttctcaatattcttcatattattatcttattattagttcctttcttaaaatgatatcctatattatctactcaaatataagataaagacagagcaatgacaaacattgcccattcttttcatttcagataacattctttgaactacatatacctaaaatctgcaaaaaatatagaactttataaatatcagcactttatagaaaggtatattcacattatactatatccggaaacgattatgctggtataatcaaggtactattatatgcttgccttcgggagtgactactaccgagcccattttgatgtaatgtttcccttccggcgaaactattacctttgtttcgctactcttgtcggaagattcttttttctcgtccatgaaactcttgtcccgcgaagtggtaactggataagtatcctccagatagctcttcatttcgtccacttttccgtctttgaaccacaccttgacagccgaccaccccgcaggagtataagcacggaatgtccaagcctctccctccttattcaaatctctaaatgcaggctctcctaaaatggtacacacctctttaaagctcataccacgttcaatgctgctcaactgcttataatcaaacccgtagctctcataaatgccacagcccgtcaccaagacagcgagtaacaagcctaaaacaactgacatctttttcataatagaaagttttagtatttatccatacagcaaatgtagtatgataaaaacctccttttccgtgattctctctatttatacatagggatttccctatcttcgaagtttattcctatctttacaacctatgtacaaagaatatcatcccagccccctgctctccccctatattgacaaatattgggagtttaaaggacaacccggatacggcatgcacatcaatatcctgcctgacggatgcactgactttatattcacgttgggtgaagctcctaaggccgtacacgacagcctcgttatgcagccctaccatgcctacttcattggagccatgaccaaatattctgaattggtgacccatacggtaacaatccatatgctgggaatccgttttctgccttgcggaatacttcgcttcatggacctccctttgcaggagctcaccaacttacggttaaacgccgatgagcttacaagcctctttacccactcttttgcagagagactgggcgaactgggaaccattcaagagcacctggtctttattgaaaacttcctgcttcaagccttatgccgatacagtccaaaagcagaacggagcatgctgttcgccatacagcaaatcaatcgatgcaagggtgacttgtcactcctccggttagcggaggagacttgcctatgccaacgccatttcgaacggaaattcaagcagcacaccggacttacacccaaagagtacagtcggattatgaagttcaaacatgctgtagacttgttgcgaagtacctctttcgacaatctgctgtccgttgccatcaaagcaggatattatgatgtttcccatctctcaaaagaaatcaaaaagatgtccggcaacgcgccaagccagcttctcacttccgctccattggaagaagggactttgagttatgtgaaaacataaaagtcgattttttacaatagctcttcctattaccatgcctatatttgcagcaatcaaatcaataaaaacatccaatatggcaacattaatcgagaaagcagcagaaatcttggcaagatgcgaaaccgtcgtcatcacttccatcaaccaagagggatatccccgccccgttccaatgagcaacatcaagtcggaaggggccacaaccgtatggttggcgaccggcaaagacagtcttaaaacaaaggagtttgcagccaatccgaaagcaggtttgtgctttcaggaaaaaggaaacagcgtagtgctcaccggtgaggtggagattatagaagacgaagccaccaagcaggaaatgtggcaagagtggttcagcgcacacttcagcaaaggcccgacagatcccaattatgtattactgaaattcaaaggacaccatgccaccatttggattgacggacattttgtacgcagaaatctttaagaagagcattctgttcctcatctgatgtcttgcatgggggaattagaactataaccccttcgttatcaccggcaatccgaaagctcctttctgcaaagtcaagactttcggtttgtcttttcgtgctttgttgtatgtggctgtggaaacatgcaaggtctctatcgctccatcctcgaaagccacctttaagtaatactccttacgtactccgtccgacacataacgatgcttgcctactttacgtctcttttcatgttcttttatcagcttctcaagtacggtgaccgtcacctcctttgtcgaagcaggagccgccatctgataatttcctaccagaaaaagcgaacaactgatgacacccacgcacaccacatgacacaatatattcactgccttttgctccatcgttgtcagccatatccattttttatatagaggaagtgtaacgactgccaccacaagtcctacccctacgggtatccacacagcagccaacgtatcttcatagatgttatatccgatgcagcccaaagctacgaccagtacaaacatcagaaaacggagtatttttataaacagttctttcattgccgcgcttatatttttggcaaatataaaaagaaatatcgttcggtcgactgtcaagtctgttcaatctacatgaactaacttgcttgatagaatgttataactacaataactaaaacagaaaatatcatggaaaagagcttaattcatagtaatgaactgcattttatcagtaagaaacgcattcatcaagcagtagagaaaatggttgagtcattggatttggctgcgggttccacaaccggcttcaacatctatgcagtagtggagagctatttcacggatttggaaaaacgaaaagaaatcaatcagctgctcaacctggaacaagatgtctgcgaagaaatagaggcagaattaagttataaataaactacggagttaccgactactattaagttacgggctacaagttgtcctgcagtatgataatgcaggacaacttgtagcccgtaacttatagtggctgatagctaataaattgaaacttgtagcccactcagtctttcgcctgatgcaccgtcaactgcgggaatgggaagtcgataccttcctcgttgaatacggagtaaatcttcttgttcatatcaaaataaacgccccagtagtctccgctcttcacccaaacacgaatcaccacattcacactgctggcatccagggcatgaagagccacaaacggctcgggagtattcaagatacggctgtcttcggagatgatacgacgcacggtgctctctaccttgtcatagttctcaccatattctacaccgatcacccaatctacacgacgcgtatcctcacggctgtaattagtcactgtaccactgctcaacgcaccgttaggtatatagattaccttattgtcggctgtggtcagaatcgtatggaagatttgaatctcacgtaccgttccggacactccctggctttcaatccagtcgcctaccttgaaaggacggaacaacagtacaatcaatccacccgcaaagttctgcaagtttccggaaagtgccataccgatagccacaccggcagatgccaacaaagctgcaaatgaagtagtttccactcccaatttgccgataacggcaataatcagcagaatggtcagcaagatattgactaaacttttcacaaagctctggatactggcatccacatgtctttttgccaataacctcgccagcattttcctaagaaaggaaatcaagaaccgtcctaccacaaagatgatgacagctccaataatacgtccaccggcacttacgccccaatctatcaattgctgaaggaatatctgcagtttgctgaaaccatcgtcagcaacttgggcagcaaaggctgccatgaataaagatgataacataactatattctttttttaaaattaatgctacaaaattaacaaataactctgagtttcgttcacttaacttgccactttcgacgaaaactcctacctttgccccgatttcaactaaggggtgccctaatacgacgggctgagatcatacccattaacctgatccgggtaatgccggcggagggaaaagaagaaaagttccccttttctgtattcatctaaacgaaacaattgcaaatgaagagacatgcaatggcggtctgcctcctgacggcagcactgggtgtctgtgcgcaggcacaagaacaagacagcctgcgggtgataaacctgcaggaagtggaagtcatctccacacgtgccacaaacagcacaccggtggcattcaccaatataggcaaagaacaactgaaaaaacagaatttcggacaagacctgccgtatctgttgagtatgacaccctccgccattactaccagcgatgccggtgccggggtgggttacaccacgctgagagtccgcggaacagacggcacacgcatcaacgtcaccgccaacggtattcccatcaacgacgcggagagtcacacggtattctgggtcaacctgccggacttcgcctcctccgtcaaggacatgcaggtgcaacgcggagctggtacctcaacgaacggtgcaggagctttcggtgccagcatcaacatgcagacgggtgatttctccatgaaaccctatgcagaattcaacggttcctacggctccttccatacgcacaaggagacggtgaaagtgggaacgggactcatcaacaatcattggtcgttcgatgcgcggctctccaacatcagtacggacgggtatatagaccgggcatctgtgggactgaactcctattatctgcaaggaggatactacaatgacaatacctccgtcaaactgataacctttgccggcaaagagcgcacttaccacgcatggaactatgccagcaaggaggagatggaacgttacggacggcgttacaattcctgcggattcatgtacgccaccgaccgggacggccatgtatacagcaaagaatattataaagacgacaacggcgagaagcattacctcacggacgaaggaggtgcactgcatttctatgacgaccagaccgacaactatacgcagaagaattaccagttgctgttcaaccacaatttcacctcgcaatggaatctgaatatcggcctgcattacaccaaaggcgacgggtactaccaggaatataaaggcgaacgctcgttgacagagtacggcatgtcgcctttcgaatacaatggcggcaaggtagaagtaagcgaccttatccgcaagaaggcaatggacaactggtttggcggtggaatcttctccgtaagctacaaagccgaccgtctgcatgcctcgctaggcggtgcactgaatcgctatgacggcgaccactttggaaaagtgctttgggtaaagaactatatcggcgaactgaaccccgaccacgactactaccgcaacaacgccacaaagaatgacggcaatatttatctgaaagccaattatgaactggtaagcggcctcagcgcctacctcgacctgcaataccgccacatcgactacaagataaacggactgaacgacaagtacaactggactgccaccactccgggaatgcagaagctggacatcgacgaagacttcgacttcttcaacccgaaagccggactgtcctggcaaatcgaccgcaaccaccgcctatacggttcgttcagcgtagcccataaagagcctacgcgcaacaactacaccgacggctacttcaccgaacatcccaaggctgagcgcttgttcgactacgaactgggatataccttcgccaactcatggctccatgcgggtgccaacttctactatatggactataaagaccagctggtactgacgggagagctgaacgagataggcgaagccatggccagcaacgtgcccgacagctaccgtacgggtattgaactgatggctggcatcaaactggactgcggcttgcaatgggacatcaatgccacactcagcaagaaccgtgtgcagaactttaccgagacactttttgaaaacgaagaggcagggtcggaagcatgggtcatcgaacacggagatacccccatcgcattctctcccgacttcatactgaacaaccgcttcggctatacgttcaaaggattcgaagcctcgttacagtcacaatatatcagcaagcaatacatgagtaacgccaagcaagaggagtgcacgctggatgcttatttcgtaagcaacctgaatctgtcctataccttcaagttgcctaaagtaaagtcggtaaccatagggtgcaccatctataatctgttcaatgaagaatacgagaataacggatacgcaggcagcggatactatctcgacgataacggaggaaaagtccgttacaactatgccggctacgctgcccaggcgggaacgaatgtattgggacatatagcaatcaatttctgatggaacatattcttgagattacaggcactgtgaccgggatcctctacctctggttggagtaccgggcaagcatttatctttggatagcgggcatcattatgcctgccgtctatatttttgtctactatgatgcggggttgtatgcagatttcggcatcaacatctattatctgggtgctgccatctacggctggatgatgtggaagtacagagctgtactacgacgtactatcttgaaacggaaagatgccccacaaaggggagagaacaacagaacagaagaacaaaagcaggagctttccattacctatatgccgacgcgctacttgctgccgcttactgccgtattcaccgccgccttcctcggcattgcctggatattgataaacttcacggacagcaatgtgccctggctggactccttcaccaccgcactgagcatcgtcggcatgtggatgctggcacggaaatatgtagaacaatggtgggcatggattgcggtagatgccgtcagcgccggactgtacatctacaaaggacttgattttacagccggactatatgccctttatacaattatagctatctttggctacttcaaatggagaaagatgatgagcaaagacgaaggattagagattagggattaagaaagatatgaaaaacgaactatcaacgagcaacgagcaattatcaactattgatgccgtagttttagcgaatggggaatatcctgccggtcccctgcctttgaagatattggcggaagcgccatacgtggtttgctgcgacggcggagcgaacgaatacatccgccggggtcatactcccgacataatcatcggcgacggcgactccctcagtgatgaaaaccgccggaagttcggacatatcctgcaccgtatcagcgaccaggaaaccaacgaccagaccaaagccgtcaacttcctgctggcgcaaggcaaacgccgcatcgccatcatcggtgccacgggcaaacgtgaagaccatacactgggaaatatcagcctgctcatcgactatctccgtgccggagccgatgtacgtacctataccgattacggcatcttcatcccctgccggggtacccgcaccttcccaagccatcccggacagcaagtatccatcatcaatttcactgcacacggtctgcatggcaaaggactggtctatcctctcagcgacttcaccaactggtggcaaggcacactcaacgaatgcaccggtacggaattcaccatcgaggcggaaggggaatacctggtattcgtcactacttcttcgcttccgccacttcaacaaagtacacgctgatacaaatcatggcaatggcagcggcttgcgtccaactgaaacggtcttgccccaaggtgagggaaacaacggtagtcaccaccaatatcagatagctgtacatggatacaaccgtcgtcttgagatacttcaagcccaccggaaccagaaagtaactgaggtaagtagggaaaaccagcacaaacgccaacaccgcccacggtacccagtgccacttcccatgcaaggcatccgtaagcaagggtgcatcccagcctataatggacgacacaatcaatcccgttactgccgcaccgccaaagatgtacttcatcatcgtcactaccccgacctcttccagcagtttcttgctcacaatcaggtaaacggcaaagaccagcgagctcaccatgcagagcatgttgcccgtaaacgcatcgtgcgccaggtcatcactgccttgcgtaaggatgcacagcaacgcaccgccaaaacccagcgctatgccgattatcttcatcagcgtagccttttcgtgcaggaaaaagacagatatcagaaagacccaaatgggctgcatggagttgaagatggcactggaaaccggagtcgtcttactgatgcccagcagatagcagaacatgaacccgtagagtccgaaagcccccaggcagaacagccctatccgctgccgccttgtggccggtgcctcctttacaaaccagcctgttatccaaaatgccacggcagcaaagacacaacgcaccgtgacacccgtcaatgcacccagccacaaagggagcagaaatttcaatccattcatattcaaccccgccatgacgcgcgatgcaaccatactgagattggcttccagtttcttatctttcatcagcttcgtatttttcccctcaaacaattcattactttgaaatgttttaggagaaaaaggagataacactatggcaaaagttaaagaagaacaatcgtctcagcaaacaaagcaagtcctcgcattctccacccggctacgccatgaccttaagaaagcctgccggcaactggatgagggagaaggacaagaggacgtcacaatcagtaaggaggtgaaggcatggctaaacaaataatatggtcgcccctcgccaaagaggcgctgaagggcctgctgatttcctcgcaagaaagagatggcaacaaacggtgtggcggggttctgtactccttattccaaaatgcattgtaccgcatcacgctgaatccgtttatcggacagcccaccgaagcagagaacatacggtacatcatcccgcatcccgactatacgcttctttaccggcacagtctccggaagatagaagtgcttgtgctatggaacaaccatcataagttgggcagcatgatagacctcatccgggaagaacccgatacagaataaagcagccaatcttgtcaagagcagatttatggaagattaacggaacagacgcattatcgtccgttcatatagccggaacaaaccatgtatccgtcccgaacatatcatctgtttatcctcgacacaccatctgtcggcgctgaacatatcatccgaaacatccgagcttttcgtcaaaaccactgggattttccaagcaaatgcccgctattccgcttgctgaagtggaggattaaatctgtaaagcactggttcaggagagtaaaccctaaggtttagcaaatgaagtgacggaagaacacaacaaaaaaggagaagcgacgcctctccttttatgctaatttaaaattgaatctgaactaagattgcagttacaaagatacaacatccgaaaggcaatgtcaagcaatccggtgtttttctttactgacgtcccattctttatacatgcatcagatattgcttgaagtccgcgaaatccttcgacatcggcaggctcttcttctcaccgcgcataaaggcctgaagcttggctggtatttctacggcttcaccgataatcttctcgactgtatccttgaacttcgccggatgagccgtttcaaggaacacgcccgtttcaccgagtttcagtccttcgaccaaagcgcggaagccgcaggctccgtgcgggtcgagcaggtaatggtccttcttccacacttcccgcatagtttcggcaatctgctcatcggtataagtggcaccgctgatttcggcagagatggcggcatggctgcctccgtaaaggtcgagtatgcgagcaaagttgctcgggtcgcccacatccatcgcgttagcaatggtagcgatactgggacgcggtgtataaatgcccgtctgcaaatattggaagaagatatcattgcggttgttggaagcgataaagcgttccacgggtagtcccatacgcttgccgaaaaggccggcagtgatattgccgaagttaccactgggtacacaaatgacggcattgtctcccttaccggcacgcttcagttgagcataggcataaaagtaatagaatgcctgcggcaagaaacgcgccacgttgatggaattggcgctggtcagttgcaggtgctcgtttagttccccgtccataaaagcggatttaaccagagcctggcaatcgtcgaacgtaccgtcaacctcaatggccgtgatattctgccctaaggtagtgaactgtttctcctggatttcactgacttttcccttcgggtagagcacatagacgtgtatgccttccacaccgaggaaaccattggcaacggcactccccgtatcaccggaagtagccacaagcacattgacttgcttcttgccctctttcttgataaagtaccccagcaaacgcgccatgaagcgaccgcctacatccttaaaggcaagtgtcggaccatggaacagctcaagcgaataaatattctccgtcacccggaccagagggacatcgaaactgagtgtgtcataaacaatctgtttcagcgtatcggcaggaacatcctcaccaaagaaagcatctgccacgcgataggctatctcctgaaagctgagtgtatcgatgctatcgtaaaactcttgtggcagagttttgattgtaaagggcatgaaaagccccttgtctgcggcaagcccctttaccacggcctcttcaagagtgacttcggaagcttgtttgttggtgctataatatttcatattaaattaaaaattaaagaattcattgataaactcgtcttctttcatcagtccgtaactgccttcacaggctgccacttcatcaaatgtccgtactttgtcagcctcgatacccggatgccagatgaggaatggaacaggttcggccgtatgcgtacggagctcgcagggagtgggatggtcgggcaatacggagatggcaacgggttcctcccaatccttcacagcctcgtagataggacctacagcacggctgtccagattctcaatcgtcataatcttcaaggggacgtttccttcatgaccggcctcatcactggcttcgatatgcaggtagacaaaatcatccgtccgcaatgcatcgagagcggcagccaccttattctcatagttggtatcataaagccccgtcgcaccttctacggtgatacgccgcagccccgcatagtagccgatgccgttaatcaaatccacggcagaaatcacggcgccgcgcctcacctgcgaaaacttgtctgaaaggcgctccatctgcggacgataaccgggactccacggccagatgctattggcagggtccttaccctcggacttccgcttcatgttgaccggatggttttccagcaacacttgcgaacggataatcaaatcgttaatcaaatcggcagtctgcttcggagtaagctctgcaccgccttcggggaccgaaatattctccgtcccctccatcggcttcaccatcaacggacggaaaggcctcaaagggacatcgtggggcggcgtacagtcaatgcgcttgtcccctccttttattaccagcagatggcggtattgcacgcccgtatggaaacgcacgcggtcgtcgcccagatgctcttgaaggtatttcaccaacacatccgcttcctctgtagtgatgtgcccggcagaatgattcttgatattgtctccctcgatgcagataatattgcagcgcatcgccatctcacctggctgcaagtccacaccgatgctcgccgcctccaacggaccgcggccttcgtacaccttcggcaggttatagcccagaacggacatattcgccacctcactgccgggatgaaatccctcggccaccgtcaccagccttcccacacgtcccatgcgtgccagcttgtccatatagggagttgcagccgcctgcagcaaggttttgcctcccagagccttcacgggccagtcgaccataccatcacccaggatgatgatgtgcttcaagcctctccccctaaccccctcccccgtagggagggggaatgagttactattgttttgtacttccatattcttctctgctatataatttatgaatgccaatctatccgctccccctccctacgggggagggagaagggggggagaggctttaaacattcgcaatactcataatatccgcaaatacccccgcagccgttacacccgcaccggctccgtatccttgtatcatcatcggatattccttataacgtgccgtggtcagcaggatgatgttattgctgccttccagaccgtaaaacggatggttagcgccgacttcctgcaagccgacagatgctttgccgttttccagcttggctacgaaacgccaatgcttgttctcggcttccaacaccttgcgacgggcctcgaaatcggcatcgaggctcggcactttcttccagaagtcatccagggagccttcaaagaagtcatcgggcacaaagaggttcttctcaacatcgctctgttccaaacagtaaccggcctcgcgtgccagaatcaccagtttgcggataacatcctttccgctgaggtcgatacgcggatcgggttcggagtaacgttcctcctgtgccatcttaatggtcttgctgaaaggaatgtcggcactgattttattgaagatatagttcaacgtaccgctcagcacggcttcaatcttcaatatcttatcaccgctatgaataaggtcgttaatggtattgatgatggggagtccggcacctacatttgtttcaaacaagtacttcacaccgcgttggcgggcaatctgtttcagttcacgatagttctcgtattcggaagaagcggcaatcttgttggcagccactaccgaaacattgtgcagcagcaagtccttgtaaagggaagccacgcctgcacttgccgtacagtccacaaagacagagttaaagatgttcataccgataatctcattacgcagcgtttccagagagctgtcctttcccttctcctgcagttcttcacggaaacgtcccaaatcgaaaccttcgcggctgaacatggctttgtttgcatcggcaatacccactacattcagctgcaggccgttctcctgcatcagcttctggcgctggctgtggatttgctctatcaggctaccgcctacggttcctatgccacagataaagagattcagtacctgatattccgacaagaagaaagaatcatggatgacattcagcgatttgcgcaatgatttgctgtccactacaaacgagatgttggtttccgaagcaccctgagcacaagcaatcacattgataccgttacgccccaacgtaccgaacagctttccggcaatacccggcgtatgcttcatgttctcgcctacgatggccacggtagccaagttcttttctgcctgaataggagaaatctctcccatctctatctctttggcaaactcctcgttcagcacctcgcaagccaggtcagcatccgcattgcgcacaccgatagacgttgaattctccgaagaagcctgggacacaaggaacacactgatgccattctttgccagcgccttgaagatacggtagttcacaccgataacacctaccataccaaggccttgcactgtaatcaggctcgtatcattgatggatgaaatacccttgatggccttgctttgcgggtcggaaacctctcgcttgatgacagttcccacaccctccggattgaaggtattcttcaccagaatggggatattcttgtggcaaaccggatagattgtaggcggatagaccactttcgcaccgaagttacaaagctccgtagcttccacatagctcaattcattgatagtgtatgccctggaaatcacacgcgggtcagctgtcatgaacccgtctacatccgtccaaatttccagactgtcggcatccagtgcggcagcaatgattgccgctgtatagtcggaaccacctctacccaggttcgttacctctcccgtcattttgtctgtggagataaaccccggaaccaatacgcgtttgggcaggctgctgaatgtttcgcgcaccaacgaatttgtcagctccgtatccagcacatgcttggaatgtttcttctccgtcttgataaacttacgcgaatcaaaccattcagctcccgtcagttgtgccacgatgatagatgaaagccgttcgccatagctcacaatcgtatcggacgtcttctgcgaaaggtcctttatcagataaataccctgaaaaatatctttcagctcattaagcagttcgccaatctgacgttgcaaggcaacctgctcctcgcctgccggaatcacttccttaatcatttccacatgacggtagacaatctcccggaactcattctcgtaagaagcatcaccggctgccgccattctggaggtgttaatcaacttgtccgtgatgccacccaatgcggacactaccacgataaccggttcatcgactgcttctacaattctcttgacgctcaaaatactgttcacggaacctacggacgttccgccgaatttcattactttcatttctctttatattgttgagatggttgatacaatgtgtcggaaacaagctgatacggcttgcattgacttttattaaatggaaaaactgcttgaaaatggtgtaacacgtagaaacacaaaatactatccctaacccctaagggtcatggtccacatggatgtgactatatgctgatagtacttgttcattgtctcttgtttctatcgtttatgataagtgttgcaaaagtaacaataaaaacattcaatctatcactttttacgacttttttgcgataaaaatacagaaagcctttaaaaaggcaagaaatatgcgcaacttacggcttacactttcacactttccataccttttttctgtatatccgtttattcttttctaacattttgctatcattctcaatatatatcattatatttgcatggaaaacatgaaagaaaagtgcgcatgaacccagaaaacacttccgttttgctaatatacaccggtggaactatcggaatgatagagaatgcagaaaccggcgccctggaaagcttcaacttcgagcagttgcagaaacatgttcccgagcttcagagatttgcgttccgtatcgacacttatcaattcgacccgcccatggactcttcggacatggaccccgatgcctggcgcaaactggtacgtatcatcagcgacaactacgaccaatacactggcttcgtcattctgcatggcacagacaccatggcctacacagcttccgcactcagcttcatgcttgaaggtctgaacaagcccgtcatcctaaccggctcgcaactgcccattggcgtgctccgcacagacggcaaggaaaacctgctgaccagcatcgaaatagccaccgaccgccactccaacggacagcccatcgtacccgaagtctgcatcttcttcgaaaatcacctgatgcgcggcaaccgtaccaccaaaatgaacgcggagaacttcaatgctttccgctccttcaattatccggtactcgcttctgccggtatacatattaaatataataatgtgcagattcatacacacggcactccccgcgaactggagcctcattatctgctcgataccaacatcgccatactgaagttttttccaggtattcaggaaaatgtcgtggcagccatacttgccactaaaggactgaaggccgtagtcctcgaaacctacggttccggcaacgctccccgaaaggaatggtttctacgccgcctgcatgatgcctgcgaacaaggcatcatcattgtcaacgtcacccaatgcagtgccggcaccgttgaaatggagcgctatgaaaccggttaccacctgatgcaggcaggagttgtctgcggatatgacagcacaacggaatctgccgtaaccaagctgatgttccttctggggcacgattatccacctgccgaaatacgcgaactgatgggacgaccgctggcaggggaaattaccgtgtgaagcacaactatcactgcaccggggtcaattctcccgtcacagaatctattatgaaaccgctgacattgacatcatccggtatcagcggatggttgacaatggcttccaccgtaccttttaccgatttctccgtatcttcgaacccatatagccaggactcgaaatccactccgcagaaacgaatcatatcaatcgtctcctgcttgataccccgggtcttcatatgctctatcatctgggcactgctcatatggcacgcaccacaatcggagtgggcaataaccataacttccgtcactcccaactcatagatggccaccatcagactacggatgacgctaccgaacggatgtgaaatgattccacccgcattttttatcatcttcacatcaccgttcttgatacctaaggccgccggcagtaaagcggtcaaacgggtatccatacaagagaggatggcaatcttcttatccgggtatttattcgtgatgtatttctcatatcccttctcggcaacaaaacgcttgttgtatgcaagaatatcttctatcatggcttttataacatgttattgttttctactcacaaaaataaaaaaactctatgggagtctgcaagccctgcattgaaaaattgtacctttgggcaatcattttagaaggaatgcgcaactatggctaaagaaaagacggtttatgtatgcagcaactgcggacaagactctcccaaatgggtaggcaagtgtccgtcgtgcggaatgtggaacacgtatgtggaagaggtggtacggaaagaagtggtgaacaagcgtcccgtatcgggcatagaaaccgccaaagccaaacccgtaaccctccatgagattgtagccgatgacgaaccgcgcatcgacctccatgatgccgagctgaaccgggtactgggtggtggtcttgtacaaggttctcttgttttaattggcggcgaaccgggtattgggaaatccaccctggtgctacagaccgtactccgcataccggaaaaacgtattctctatgtatccggcgaagaaagcacccgccaattgaaactgcgtgccgaccgcttgacaagcacctccagtgactgcctcatcgtgtgcgaaacttccctggaacagatttacgtccacatcaaaaatattcgcccggatatagtcatcatcgactccatacagacaatttctaccgaaacccttgaatcgtcgcctgggagcatcgcccaggtacgggaatgttccgcctccatcctgcgctttgccaaggaaacgcatacggcggtcatcctcatcgggcatatcaataaggaaggaagcatagccggccccaaggtactggaacatatcgtggataccgtactccagttcgagggcgaccaacactacatgtaccgtatcctgcgcagcatcaagaaccgtttcggaagtactgccgaactggggatttacgaaatgcggcaagatggattgcgccaggtgagcaacccatccgaactgctgctgaaccaggaccatgaaggtatgagcggcatagccatcgcctccgcgatagaaggcatcagaccgttcctcatcgaaacgcaggcattggtcagcagtgccgtatatggtaacccgcaacgctctgccacagggttcgacatccgccgcatgaatatgctgctggccgtattggaaaagcgtgtaggcttcaagctggcacagaaagacgtctttctcaacattgccggcggattgaaagtgaacgacccggcaatagaccttgccgtcatcagttctatcctctccagcaacatggacacggccatagagccggaggtgtgcatggcgggagaaataggtctgtcaggtgaaatccgcccagtgaaccgcatagagcaacgtatcggagaagcagagaaacttggattcaagcgattcatacttcccaagtataatatgcaaggactgaacacgaagaagattaaaatggaattgataccggtacggaaggtggaagaagcattccgtgccctattcggataatcattatgatacaagaataccaactgcgcgtattgcccgaagtagcggcaaacgagcaacgcctgaaagagtacttaatacatgagaaaggactgaatgcgcgggagataacagcaacgcgcatcttgaagcgcagtatcgatgcccgccaacggaccatctatatcaacctcaacgtacgggcatatctggacgaaatgccgaaagaggacgaatatcaacataccttatataataatgtagaaggaaaaccccaagtagtagtggtaggcgccggtcccggaggactcttcgccgctctgcgcctgatagaactcggtctacgccccgtcattgtggaacgtggaaaggacgtacgggaacgcaagaaagacttggcgcaaatcagccgccagcaactcgtcaacccggagtccaattacagcttcggagagggaggtgccggagcttactcggatggcaagctgtacacacgcagcaagaagcgcggcaatgtagacaagattctgaacgtcttctgccaacatggagcctccacttccattctggtagatgcacatccgcacataggtacggacaaactgccgcgtgtcatcgaaaacatgcggaacactatcatccagtgcggtggcgaagtccactttgaaacacgcatggacgccctgctcatagagaaggatgaagtcaaaggcattgaaacaaataccggcaagactttccttggcccggtgatacttgccaccggtcactctgcccgggatgtataccgctggcttgccgccaacaatgtagagattgaagctaaaggcattgcggtaggcgtacgactggaacatcccgccaccttaatagaccaaatacaatatcacaaccggaacggacggggaaaatatctgcctgccgccgaatatagctttgtaaaccaggtagacggacgaggagtatatagcttctgcatgtgtcccggtggttttgttgtgcccgccgccagcggtcccgagcagattgtagtcaacgggatgagtcccagcaaccgcggttcccgttggagcaattcgggaatggtggtagagctacgcccggaagacatagagcaatttactattgacaatctacaatttacaatttctatgcagcacgacagcgcggctaattgtcaattgccaaccgtcaattccccattaagcatgatgtactttcaagaatatctggagcgcctctgctggcaacaaggcaatatgaagcagacagcaccggcacagagaatggcagacttcactaagaaaaaactaagttacgacctgccggaaacttcgtatgcaccgggattggtctcctcgcctctccacttctggatgccttctttcattgcagaacgcctgagcaaaggttttcagttattcgggaaatacagccgggggttcttgacgaatgaggcggtcatgattggagtggaaacccgtacatcggctccggtacgcataacaagagataaggagacactacaacatgtacgcgtaaaaggactattcccctgcggagaaggcgctggatacgctggcggcattgtttctgccggaattgacggcgaacgatgtgcggaagcggcaaaggcattctttaattaagctataatatttacattcaaatttttattttatcgtttaatttgtaaacaattatcacatatacattgttttattgtatttatagaaatatttatatgagattcatcagaaacattgtatgctttctatttttcttacctttcattgccacagcgcaaacctataaatacatcggagtggaaaacggattaagtaaccgcagaatcttcgacattcaaaaggattcaataggttacatgtggttcctcaccaacgaaggcatagaccggtacaatggaaaagacatcaaacattacaaattaattgaagaagataaaaagtcaaactcccccatccatcttggctggctatattttgaagaccaagggaaattatgggtaataggcaaatccggatgcatttttcaatataaccaagaacgcgattcgttcaacaggatatataaactgcccaaagcatcggtcaatatcagctgcagctatatggatcacaataatagaatttggctatgtagcaaatacagtatcattctctatgacacaaagaccggagaaacccatcaaatgcccaatgaattaaaaaggagcattacaagtatcgaacaaatagacaataaccacttcttcatgggcaccagcaagggagcgcgatacgtcaaactcgaaaacaaaacattgcagattgtccctcttgaacctcttgacaaaatccgggcccaaatcagtgcactctatttccaccaagagtcacaaagacttttcatcggtacttttgaaaaaggagtctttgcctacgacatacggcaacaacgaattatacactccaatacagatttgagcgatgtaaacatcgcccgaatcagacctctgaaccggacagaactattgatagcgacagaaggtatgggcatacacaaaatcaatgtgaactcgtgcatctcggaaccgtacatcacctccaactacaaaagttacaatgagatgaacagcaataacatcaatgacatttatattgatgaagaaaagcggatatggatagccaactacccggaagggattaccattatagacaaccggtacaaaaactacaactggataaagcattccatcggaaacagacaatcgctggtcaacgaccaggtgcactctgtcattgaagacagtgacggagacctatggttcggaacaagcaacggaatcagcctttatcaatcaaaaaccgggcagtggcattcattcctgagctctttcgaccatcaactgaaagacaagaaccacatcttcattacgctatgcgaggtatcacccggcattatttgggcaggaggatatacttcgggagtatacaaaataaataaaaggacactctcggtagaatatttctccccttacctgctcaatccggacaacattcgtcctgacaagtatatccgcgacattgtaaaagactccaaaggatatatctggtccggagggttctacaatctgaagtgcttcgatttgtccctgaattctgtccgtctgtatcccggaataaattccatcaccgccattacagaaaaggacgacggacacatgtggattgggacaagtaccggactatatctgttggacagagagtcaggcagattccaatatatcgccttgcaggaagaggcgacctatatcaacacactttaccaagcggaagacctctctctatatataggaacaaacggctccggagtggttgtatacaacgcaaaggacagtacgttcaagcattatcataaggacaattgtgccttgatttcaaacaacatctacaccatactccccgagtcggacgggcatatcctgatgagcactgaaaacgggatcagctgtttccaccctgcggagaagatattccacaactggaccaaagagcaagggctgatgtcctcctgcttcagcgcctcttccggaacgctacgcaagaacaagggttttgtctttggcagcacagacggagccatcgaattccccgaaggaacccgtcttcccaagtacatctactcccccatgatactcagcgattttcagatattctatcagacagtctttcccggcagtatgaattcccccttgaaggaaaacatcaaccagacagaccggttaaagctgaaatataaccagaacactttctctctcaacatttcatccattaattatgacgcaccggacaatgtcactttctactggaaattggaaggattttacgatgactggaaccgactgagtgaagaagggcatctccgcttcaccaatcttgcctcgggcgattacaagctttgcatacgggcggtatccaaggaagagccgtatctctattttgaagagcgaagtatcgacatcagcattgcgcgtcccgtctggttcagtttttgggctatagcttgctatgttttattggcggcattgatgttcattaccggttttcgtatcatagcactgagaaaacaaaaaaagatatccgatgagaaaacccgcttctttgtcaataccgcacatgatatccgcacgccattgacactgataaaggcacctctggaagaaatgcttgaaaacaagacattgaacgaagccgagaccaacaatatgtacatggcactgagaaatgtcaattcactcctgcacatgaccaccaatctgataaacttcgaacgggcagaagtatattcctcccatctgtacatagcagaatatgaactgaatacttatataaaggagatatacaatattttccgtacatacgctgccataaagcacatttctttcagatatgaaagtaacttcagttacatgaatgtgtggttcgataaagagaaaatggactccatcctgaagaacgtcatatccaatgccttgaaatatactcctgaaaaaggtgacatactcatttccgtatatgacattggaaatacgtggagactggagatcaaagacaatggcatagggattccagccaaagaacaaaggaaattattcaagatgcacttccgtggtacaaacgccattaactccaagaccacggggagtggcatcggtttaatgctggtacggaaactggtaaacctgcacaatggcaaaatacacattgaaagtaccgaacatcaaggcactactatcagaatcaccctgcccaaagataaagaacagttcaagcacttcacattggcaatcaaagagaagaagtctgcctatgaactggacgttcccattactccttcggaacgtaccgactctttcctgaccgaagacaaggacaaactgcaacgtatcttgattgtagaggacaatgacgagctacgaaactatctgctccagtcattctcccccaattacaacgtgcaagtatgcggtaacggcaaagaagcgcttgctattgtaaaacaattctggccagaactgattctttccgacatcatgatgccggaaatgcgaggagacgaattatgtacagccatcaagagcgacatcgaaacttcccatatcccgatactactgctgacggcactgggagatgaaaaaaacattcttgaaggtctccagatcggtgctgacgaatatattgtaaaacccttcagcataaacatactgaaagccagtatagccaatctgcttgccaaccgtgcattgctacgtaagaagtatgcagatttggaaatcaatgcagcagaagaggaacctcctacagctacttgttccaatagccttgattggatattcatgtccaatgtaaagaagaacatcgaagataacatagataatcccgatttcacagtagacaccttatgttctctcctgaacatgagtcgcaccagtttctacaacaagctgaaagcgctaaccgcccaggccccggcagatttcgtacggaatattcgtttgaaacacgctgccaatttactaaaagagggaaaatattctattaccgaagtcgcagaaagaaccggtttctgcgatgggaaatactttcgggaagtctttaagaaatatttcaatgtcagccccagccaatatgcgaaaggagacactccctgctcccccaaaggagagggagaatagttctgcataggagaatttttcattttgcagccccacacagccaaaccctaaaaaattatccgtatttttgcagaaacaaaaaacgagaatgactcctgaaatagcaatcgtcgactccaacaccctctcctgcctgggactgcagaacttgctggaggaaatcatcccgacagccgtcatccgctctttccgttcctttggtgagctgatggatgatacgcctgacatgtatgtgcattacttcatctcctcgcagatttacttcgagcataccgctttctttctggagcgcaaacccaaaaccattgtgctggtcaacggtgaaaccgttccccaattgtcgagcgtgccgacgttgaacatctatcaggacgaacagaacctggcaaagaacattctgcagctgcgtcaatacggagaccaataccacctgcaccaaggcagaccggagtctgccggacacgcaaacatggcaccagacaccaccagccacgacctttccgcccgagaaatagaagtgctggtgctgattaccaaaggcctcatcaacaaggagattgccgacaaactgaacatcagcctgaccaccgtcatctcacaccgcaagaatatcaccgagaagctgggcatcaagtccgtatccgggctgactatctatgcagtcatgcacggatatgtggaagccgacagaatataatcctgcaaccggaacacatcagaagcggagtttttcagaaaggctccgccctaatcagtgtacttgtatgccaaagtttactccacgatggaacgatattttccacatgatagagcgatttaagattagcactccaagaacgaaatcctaataaatgaggattgccccttccgcaagaatccccttactttgcaggtacaaaaaaacagtttatgaacagatatagaattttagccggcatcttctgccttttggcaaccggcaatgtacttgccgaagaggcagacactttgaaagtggtagacgtagaggaaataaccgtcattgctaccccaaaagaaaaccggaaactgcgcgagcagcccactgccgtcaccctgctttcgcaacaggacatgcagaacgcacaagtaaactccatcaagaatctgacatccgtagtgcccaatatatttatccccgactacggatctcgactgacttcggctgtctatatccgcggcataggttcacgcatcaacactccctccgtaggactttatgtagacaatataccttatatagacaagtcagccttcgacttcagctatgccgacgtagagcgcatcgacgtgctacgcggtccgcaaggcacgctctacgggcgcaatgctatgggcggattgattaaggtacacaccaaatctcccttctcctaccagggaacggacttccgcatgggggcaggtacgcacaatgcctataatacctcgctgacccactatcatcggctttcggaacggttcgccttttccaccggagggttttacgattatcaaggaggattcttccgcaacacggtgagggacgagaaagcggacaaggggcaatcggcaggcggacgcatccgcgccatttacctcccttcggacaactggaaggtggacctgaacatcaactacgaatacagcgaccagagaggatacccgtatttctatcaaggtagcctggcccccgaagcacagagcgaggcgatgaaaccctacattggaaaggtctccaacaatgcccgaagcaactattaccgcaacctgctgaacaccggtctgaacctggaataccaggcacagcacttcacgttgagcatggtcaccggctaccagtttctaaaggactgcatggacatagaccaagacttcaccgccaacgacatctataccttgcaacagaaacaatgctcccacgcactgagcgaggaaatcatcttgaagagtaaaagcggcaaccgctggcaatggaccaccggtgccttcggcttctaccaatggctgaatacggaagctcccgtaaccttcaaagaagccggaatggggatgctgaaccagatgttgggtagtgtcattccatcacaaatacaagtagagatgggtccgtccatgagcatgaatatcctgccctcactgggcatcatcagccgggctatgcccatcggaggcagtttcgacactccgctgctgaatggggcgctctttcatcaatccaccttcagagatttattcgggctgaaaggagtgtccttcaccgccgggctacgtttggattatgaacgtatgaacatggattacaactccggcaccagcctggagtacaaggtgggcatcaagggagaaatgaagcgaggcgatgtcgtcatccgcgaaatagagatgatgccggagacagcgctgaccgtagagtctcgctaccagggaagtatcgacaaagattatcttcagctgttgcccaagtttgctttgcagtatgactttgcgcgaaacagaggaaacatttacgctacggtcagcaaaggttaccgttcgggaggctacaacgtgcagatgttctccgacttgctgcaatccagtttgaaaaacgacatgatgcggcaaagcaaagaggcgattatgtccaacgtaccggatgcctacaaagagttggtgagcaaatacttccccgatgcaggagagaatccggatgcaaaatctgccactgtctataaacccgaacaaacctggaactacgaaataggaactcacctgaatctgtttgacggacgtctgcatgccgacgcctccatcttctggctggaaacccgcgaccaacagatttcacgtttcgccccaagtggactgggacgtgaaacggcaaatgccggtaaaagccgcagccaaggggcagagattgccttgacagctgccgttactacggatttcacgctgaatgcaagttatggctatactcgtgccatctttaaggactacatcaccaacgaaaaagtaaatggtgagcttcaggaaatcagctacaatggcaagtatgtaccttttgttcccaagcataccatgaacgtgggcggtcagtacatcttccgcatccgtccggggtactggctggaccgcatccagctgaatgctaactacaccggtgccgggcgcatctactggaccgagaaaaataccgtgagccaagccttctacggcacgctgaacggacgcatcagcttccagaaaggacatggacaaattgacttctgggtgcgcaatgccctcaacaaggattacgcctccttctacttcgagagtatgggaaacggatttatgcagaaaggacgtcccgtgcaagcagggatagaactacgatgcagattctgatttccttattcattgatagctccgcaatgcggacagactcccttctcccttaatttctgcccgcatctgccgcaacgatagcgtgaagccagcagcgaaatacgaagccttttgaggaatacccatacaaaagcagccaaaaacaagtatccgacgtagatagatgtagtaaggataaagaagaaataacagaagatgcagcaggaggccagccccaacagatagaatacggccgccgccggacttaactggcggaacaaatcgtcgagtaccgccagcaacaccacgataaacagccagaatcccatcagaaaagcagaaagcacaaacggtaccttgaacggcgacaaggtaggattaaaatagaagtgttgccacgtctccggcgcaaacacttgtatagattcgtaaatagtggcacagaacgccatcaacagacatagcaacaacggatagagactgtctatatcattaaagtacaccatccttagctgcttgcgccgaaaagcccggaacagccagactgtcacaaacaaggcaaaaataatgataaaataagaggcatgggtatcactgaacaagtagatggcctgcgaaatgctgtctgtaggaacaaaggcatgcatcatttcggactcccgcaaccagccctgcacttcctgcgaatgggcaagcttcacccatacactatccacactgtcggcaggatggatggcgaactcggcaaccaccacgcggtctccccgataaagcatattataacagtccttcacgggcagacaagccaaattcacagaatctgccagcacttccagattggtattccaagtataatgccgttcaaaaagataggtcagcgaatcacgcgtctccttagacagatgttcatcttcaagattaggacgggaataatgacaggaaactaaagcaatgaagcataaaaaataaagaatgcagaataggagggaacgcagtgaacgcaaaggatgtttgtccctgcccgcttcccggtaccggtcatttgccagcctttcattatgtgcccgttcctcactcctcattttcaagtctttattagtaattcctcattcttcgtccttcattaaagcggctcttcatgagcaatgactttcatctggcaattcttacaatcaaacgacaagcggaaacgcttgccgtccgtcccaaccaaataataaggttccctatagggagaatgtcctttctgataggtgggacaccatcccatactgaaacgcaggcaatgtttgcagaacatgagcacagcctctggaaccgcttgtgcctcataggcaggcgctatagacgagagtccatgctcacggtaaaaactccgggcagcactgttcatcacattgcccagataggtcagcgaagtagctgggaaagcatggctggtcggtttccaaacagccagctcacgacgataagtaacacgccgagcctcaatcagcttatctatcacctgccggcgccagtctgccaccacagaagcaggaatgaaccaattcgcagaaagattgagcctgatacccgacgcctcttctgataaatgcccggctacctcgaaaggtgtatttcccaacttagccagttggctgcgcaggttatccgcctgcggtgtacgtgccaactccttcggataagggaaagaaagtgtcacgcggttatcatcttcgtccgcagccgtcaggctaaatccgaaagaattatctgccaactcccaacaaacaccgattttgcgttcggaggatttacgggtaaggatacgttcaaattcctggtcgaagttacgataaagccgggtacgtggtttaatacggggcacttcccctgccggatagagcttgttgccatccacccggttgatacggaaaccttgcaaacgtccttgctcatccaagaagcagacaccgtctccgttgtggaaaggctttatgcctgccaccgtgagatagcccccgcgctgttccttcaaagtgcccatctcctctcccaaagatttgggcgtatcgaacgaagtgatctcccctccccttccttgcaggaagtaatgagtgaaaccacgactgaaactcttgtccaactgtggctgaaaatcgaaacggcaagtgcccgaagaggcacgggcatattccttgcgacgggcaaaaatggcatcgagtcgcctacggtaagccgccgtcacattcttcacgtacgtcacatccttcaagcggccttctatcttcaaggaagtggctccggcatccagcagttcttccaacacctcactttggttgaggtctttcaaagaaagcaaatgcttattacgcacaatggtcttgccatcggcatctaccagactgaagggtaaacggcagaattgcgcacattccccccggttggcactccgtccgaaacaagcctggctgacatagcactgcccgctataactgacgcaaagagccccgtgtacaaagacttcgagcggcacgtcgggacacgcctcatggataccgcgtatctcctgcaaagaaagttcgcgtgccaacaccacctgacggaaaccggcatcggcaaggaaacgtactttctccggcgtacggttatccatctgtgtactgccatgcaacgggatgggcggcaaattcagccgcgtaatccccatgtcctgtacaatcagcgcatccacaccgatacggtacaattcccaaatcatcctctctgtctctttcagctcttcttctttcagaatggtattgaccgtcacatagatacgggcattatacagatgggcatgctccaccaaagcggcaatatcctccaaagagttgacagcagcagcacgcgcaccgaacttgggtgcaccgatgtagaccgcatccgctccatgattcacagcttctatgccacactccaaattcttggcaggagccagcagctctattttacgttgttttatcattgttcaattacgagtgacaagtgacacgctactcactctatatcattaatattatacggtgtctcctgatatacaaaataattcagccaattggagaacaacagattggcatgggcacgccaacgcaccaacactcctttgtccgggtcatcgtccacatagtagttacggggtatctcgatgggcaggcccttattcaagtcacggcgatactctgtgtccagcgtcaacggagagtattccgaatggccggtcacgaagaactcacgccctccacgggccaccgccatatatacaccggcatcctccgactcggaaagcagcgtcaattccggaaccttctgtatatcttcccggcgcacttccgtgtggcggctatgcggcacatagaacatatcatcaaatccacggaaaatgggatgcaacggttgcaaggtacgatgttcaaagataccgaacatcttcttatccagtgcatacttcggcactccataatgatgatagagccctgcctgcgccgcccagcagatgtagagcgtagaggtgacatgcgtacgcgcccagtcgaagatttcagtaatctcatcccaataagtcacctcctcaaaatccatctgctctaccggagcaccggtgataatcatgccatcgtacttttcaccgcgcatcttgtcgaaatccgtataaaatgttttcatgtgttctatcggagtgttcttggaagtatggctttttatcttcatgaacgagatttccacctgaagcggagtattggaaagcagacgcaccaggtccgtttccgttgtaatctttagcggcatcaagttcagaatcacgatacgcagcggacggatatcctgctgggttgcccgggaattgtcaatgacaaatatattctcctctttcagcaactcgatagcgggtagtttatcgggtaaatttaaaggcatgagtttatatctatggtttaacttattactgtctacgattttagcgtgtaaagttaggcaaaaaatcagagtgtgataaataaattataaaagttttatcgatttatccctcttcatttaacacgtttaattacatttgtacccgaaacctattaaaagttattaaaaaataagattaaaaagcactgcggcatcaagcgtgatactgataattagcatccaaaagcgtaaaagacttttccataccggttatagctctgctaaatccatatttttaagacaaggttcattgagtataattgggaaagcggaaaaaccgttgccccacaataataatataatgaaaaaacttattcttgcaagaggagtcttagctgcctctttattctgctgcgtgtccttagggaatacagcttgtgtgaaccggattgacgaagaatcagaagcggaaatcgaggaagggacgacgcctatcacgttctctatcaaaatagaaaaggccagtaccaaggtcacaaacaccgcctttgaaaaaggagacaaaatgggcttgtttgcaaccacttcctccggctctatcaaggggaaacggtatattgacaatctggctctggaatatacggaaggctctacactgattccccaaaagacagtattctatccggaaggagatgtgccactggactttatcagttaccacccttaccaaaccgaaggggtagttgccggtacacccgttcttcccgtatctgtacagatagaccaaagcaatgagaaaaaccgcgcacaaagtgacttcttggtagctaaagcgcaaggaatcaccaataaaaccaaatctgtaaccctggagttccaacacaagctgtccaaactggcaatctctctgacacccgacacaagcaactctgccaatgatttgctgaaagccaatccgcgtatcatcgcaaccgggctcaagacctcggccgattataatctggaagacgggactttcagtaatcttacggggacacaagacatcatagcctccggtgaatggagtgtcaaagacaacaaacttaccggcaaggaattcattatcataccccaaacgataaatgatggcaagcaatccttcattatggagtggagcggacgtatatacagttgtgcaatacccgaagtggaaatgagtagcagcacgcaatgtatcatcaacatatcagccatgcagagcaacagcaacgtcctgagcagctttgccggcaaaatcaaggaatggagcagcctccctcccatcgacaccgataatatggaagattacactgccatacatatttccgctctctccttttctctttcaaatgtatacagaatttatcacgaagggatacccattgcagaagtctgcaaggaatatctcaaatcagcgtcattgacttccagagccgttatagcctatcccataggtaaaaatgaaaaggccgacctgagcaatggcgtcatcctacagcttgcggaccgtaaagacaccatctgcggaggaagaataagctggaatacagacgactatggatttacctacactaaaggggaatataccggcatagacaagctctatatagacaacagccataaactacttctggaaaagccggaaaacgccatcaaggtgaatgtggcatgctacacccttcgagacatcagaaaaggagtgtctaccgaataccccattgtcaagattggagcccaatactggatggggaaagagctccatgccaccacctaccgtgacggaactcccttgaaaaaacagattgatttgggaacagacaaagccggatattacaagccggataagtatgatatttatttttacaatggagaagccatactggcaggagagctggtacccgaaggctggaaaataccatcggatgcagactgggaacagctgaaaagctataccggcaacgacagctccatactaaaagccggagaatggcagacaatggtatccggtgaagtagcccccgtcaacaactatacccggttcaatgcttttcccgtaggaatgtggtacaacaaggggcacaacagtccaaacaaaatgaccgccttctggagttgggatcatacaaagcataccctttcggaaagcaccatttattttctcggcgaaagcgacgagtttgtctcaagcgccgcccatgtcaccggcaagccctactataaagctctttccatccgctgtataaaagaatagccggcaatttcgacatttctcatttcttttttgtatttttgttcccaatgtgcaagatttttgccaatcggacaaagataacgaaagagaaatgagagtaatcgacctgataaacagtaacgaaaaaacagctttttcctttgaaatattgccaccactgaaaggtacgggcatcgaaaagctgtatcagaccatagatacgttacgggaattcgaccccaaatacatcaacatcaccacgcaccgcagcgagtacgtgtacaaagacctcggcaacggattgttccagcgaaaccgcctgcgccgccgccccggcaccgtagccgtagctgctgccatccagaacaagtacaacatcaccatggtgccgcacatcctttgcagcggcttcacccgcgaggagacggagtacgtgctgctcgacctgcaattcctcggcatcaccgacctgctggtgcttcgtggcgacaaggcaaagcacgaatcttcgtttatccccgtaggcaacggttaccaccacgccgtcgaactacaagaacaaatcaacaacttcaataaaggcatctttgtggacggctccgagatgaaagttaccaataccccgttttcgtacggcgtagcctgctatccggaaaagcatgaagaagcccccaacatggatacagacatctactggctgaagaagaaaatggaaatgggtgcagagtatgccgtgacccagctcttctacgacaaccggaaatatttcgacttcgtggaacgcgcccgccaagccggtgtcaccatcccgattatcccgggcatcaagcccttcaagaagctgtcacaactcagcatgatacccaagacgttcaaagtagatttgcccaaggaactgacccaagaggttctgaagtgcaacaccgacgcagaagctcagcaagtgggtatcgaatggtgcgtgcagcagtgcaaagagctgatagcccatggcgtcccaagcctccacttctactcggtaggagctacagacagcatcaaggaagtagccaaacaaatctactaaacaatggacaatcaacagttgacaattgacaacaggcagtgtcacaagtaataacttataactaattaccccgtgttcagtttcaaggacataataggccaagagccagccaagcaaaggctgatacaagaagtgcaggaaggacgtatcccccacgcacaactcttctgcggccctgccggagtaggaaaactcccattggcacttgcctatgcccgctacatctgctgtcccaaccggacggaaaccgatgcctgcggtacttgtccctcctgcgtgaaatggaacaagctggtgcacccggacgtacacttcgtataccctatcgtcaagagtgccaaagggaaaaaggaagtctgcgacgactatatcaccaactggcggcacctgctgctgaacagcccctacttcggactgaatcattggctgaacgagatggatgccgaaaacgggcaagccatcatttatgccaaagaaagcgacgagataacccgcaagctcagtctgaaatccagcgaaggaggttacaaagtcaccatcgtatggctgcccgaaaaaatgcacgaagtctgcgccaacaagctgctgaagctgctggaagagccgcccgagaaaacgatattcctcctcatttccgaagctccggaaatgatactgcccaccatcctcagccgcacgcaacgcttcaacatccccaagattgaagaagttgacatagcaggagccttacagcagaagtacggagtgcagccccgcgacagcgagaccatagcccacctggcaaacggagactttatcaaagcattggagaccatccatatgaacgaggagaacgaactgttcttcaatctctttgtcagcctgatgcgactctcctaccagcgcaagatacgggaaatgaaacaatggagcgagcagcttgccgccatgggacgcgaacggcagaagaacttcctggactactgccagcgtatgacccgcgagaacttcatctacaacctgcaccgcaaggagatgaactacatgacgttgcccgaacagaacttcgccacccgcttcgccccctttgtcaacgagcgtaacgtcgtgggcatcatggacgaactgagtgaagcgcagcgccacatcgagcagaacgtgaacgcccgcatggtgttcttcgacttctccctcaaaatgattgttttattgaaacaatgaaaagtggcaagataatgaaatgcaaagtatcaaatcgtaaatagtaaatagtcaaatagtaaataaacagatgatggaatttaaactacataacggaagcggaggtctctgctgcaagagttgcggcaggcaggacaagcaactgaacacctacgactggctggccgacataccgggcaatgccgatgagagcgagctggtggaagttcagttcaagaacacccgcaagggatatttccgcaacagcaacaagatacccctggagaaaggcgacatcgtagccgtagaagccacccccggacatgacatcggcgtggtgaccctgaccggacgcctcgtgccgctgcaaatgaagaaagccaatatcaagtccgaggcagacatcaaacgcatctaccgcaaggcgaagcccgtagatatggagaagtacaacgaagcaaaagcccgcgagcacgccaccatgatacgctcgcgccagattgccctggacctcaacctcaacatgaagattggtgacgtggaataccagggagacggcaacaaagccatcttctactacatcgccgacgagcgtgtggacttccgccagctcatcaaggtccttgccgacgccttccgcgtgcgcatcgagatgaaacagattggcgcccgccaggaagccggacgcattggtggcatcggtccctgcggacgcgaactctgctgtgccacctggatgacctccttcgtgtcggtatctaccagcgctgcacgcttccaggacatatcactgaatccgcagaaacttgccggacaatgcgccaagctgaagtgctgcctcaactacgaagtggactgctacgtggaagcacagaaacgcctgccctcacgcgagattaccctggaaaccaaagacggcgagttcttcttcttcaaagccgacattctgagcaaccagataacctactcaagcgacaagaacatccctgccaacctggtgaccatcagcggcagacgcgccttcgagattatcggtttgaacaaacgtggcatcaagcccgacagcttgatagaagaagcccatcgctccgaacccaaaaagccggtggacttgctggaacaagagagcctcacacgctttgaccgcagccggaaaggcaagagtggcggtgacggcaacggtaacgagaacagcaacaacagccgtaacaagagaaagaaaaagagtgggaacggtcgtccgcaaggaggtgagcagggtgctccccaatccaacaaccagagagaacaatccaggcaagaccggcaaccgagacagaaacaagaccggcaagtacccaaacaaggtgaacagcaacaaggcgaacgtcaacaacggaacaataacaaccgtcgtccgccccgtaacaataagcccaaacctcaaggtgaaagacctgcccaaaatgacaaaccggctcaagaataggaatctctgcctgaaaggtatcatactactgtttgtcgcaagcctgctgagcgcttgcgacaaacagaccgtataccattccttccaatccctccccaccgaaggctggccgcgcgaagacacgctctctttcgacgtgaaggtcaccgactcactgacctactacaaactgtctctggaagttcgtaaccgaagcaactacccctatcagaatctacctctatccatctgctacaccaccgcagattccatcccttcccccgcagacaccatacagctaatcctggcggacaaagaagggatctggaaaggtgacggctggggaggtctctatcagactgccgtctccgcaggaagcgttcaaatcggcaaacccggcacctacctctttaaagtggcctatacgctaccggacgaaaggctgcaaggaatcaatgacatcggcatcaaactgaagagatagaaactccctattgttctttatcaccttcttctaacaaccatctcagtctcccactcacgtctccttgaagcggaaacgggcggggtatcataacttgccctcttacctcatagcgttacgtcttttacgccagaatgtatcggccgttacaccagcatgtaaagggcgttacaatatagcgcaaaggacgttacaatgcggtgtaacagcctttacattacgatgtcaacaatgtgtaaatgcaatgtaatgataatcaagtccattcgtatgtcccacaaggaaacggtcataactaaattcggcgattacgtcctgcatcaatccgcagaaagataaacagcaggattgtgaatccccagagagaagaacctccgtaactgaagaaaggcaaagggataccaatgacgggggtcagtcccagcaccatgcctatattgatgaatagatggaacaagaatatactaagcacagagtagccatacacccggccaaagggggattgctgccgctcggccacggcaatcagccgtaaaataagaataaggaacagtaacagtacagccgtagaccctacgaatccttcctcctcacccacggtgcaaaaaatgaagtccgtatcttgctccggcacatacttcagctttgtctgcgtaccgttcaagaaacctttgccggtcagccccccggagccgatggctatcttcgactggttcacgttatagccggcaccagcaaggtcctcctccataccgagcaccaccttgatacgtatctgctgatggggttccagcactttattgaagaagtagtcgctggagtagaggaaacctatcgaacccaaagcaaacagcccaatcagaaaataagataaatggcgctcgcttaaagaaagaaagacaagatacccgacaacaagtgcacaaagcccccactgcacccacaccaagttgaagggtaccacgtattccgaaatcagataagccacgagcagcactcccagcgaaccgccgataatattccgcgtgggctcccagcgctttttataaacccacaccatgcctccggcaaaaagcagtaccatcagcaacacggcaaattctccgataggcgtcggcgtatcggcaatcatcaccgcatcaaaacggatgcccaccacaaagtagaccactgcacatatacccgagaacagtaccacgcccggcattccctcccgataaagcatcaggaaaaatgcagagtacaccaatgccgaacccgtctcccgctgcaggataatcagcaacatggggaagagaatcaggaaagccagcataagggagcttttccagttcttcatcgtaaacgagtaggcgctcatatacttggcaagcgccagcgccgtggcaaacttggcaaactccgccggctgcaaactgaccggccccaggatgagccacgaccgcgaccctttcgtgtcaggcgcaatgaatatcgtgacaatcagcaacagcatcagccctatatatataaggtaggagaacatgtcatagagggaatcgtccagcatcagcagcacaaaccccaacccgaaggaacatataatccagacaaactgcttgccggcacgcgtagagaagtccagaaagtcacggtcaccataatcataacttgctccacaaacactgaaccagccgaatacaatcagcagcaggtaaacgacaatcgtcacccagtccaatgatttccatatgctatctctcctcgtcaccaatttatttacaattttacgatttactatttactattgaagccacccacagttcatccctaacccctaatcatcatctctcctcatctccgtaaagtatcacccggttactgaattcttccgcccgtatctcattctcgggcgacagctttccatgcagatactggtccatcatcatggcaccgataggtacgccatacgtggcaccgaaaccaccgttctccacatagacggcaatggctatcttagggttgtccatcggggcaaagcccataaagacagaatggtccttgccgcggttctgtgccgtacccgtctttccgcagacctccacacccggcaggatggctcccgccatgcggcaagtggcgctacccgtacttccgtctacagcggcacgcatacctttcaccaccatttcataatattcgcggtcgatggtgggataacggggattgcgatagatgctgtccagttcattgtcttctatctccttcacgatgtgcggagtaatgaaatgcccccggttggcaatggtggcacccagattggctatctgcaagggtgtagcaagaatctctccctgcccgatagcgatactgataaccgtcagaccgttccacgaaccccgatagggcttgtcgtagaactttgcattcggtatcagtccacgctgttcgccggggaggtcggtaccgagccgatagccgaagccctgcgataccatgtggtctttccatacggtaatggcattctgcggcgaaccgtattttttatcaccgaacatgcgatacaatccccaacagaaataggaattacaagaggtagcgatggcaggaatcagcgacagaggcgaaccatgtccgtgacatcccacatgaaggcctttatgattgaaaccatgcgcacaagggaaagtcggataatcttcgtggataatctcttcctgaaggaaagtcagtgcctgcgccgtcttgaaggtggagcccggcggataagctcccatgatggcacggttcaacaaaggcttccgcttgtccatctgcagcaggcggtggttctttccccgctggcgccctatcatcagatgagggtcaaaggtaggcgaggaaaccatgcacagaatctcacccgtagccggttcgatggccacaatggcaccgattttgtgttgaagcagccgttcgcccaacatctggaggtcaatgtcgatgcctagtgtcaggttcttgccgggtacggaggaacggtccaactgtccgtccatgtagtgtccctggatgcgcccgtgagcgtcacgaagcagaatctccacccccttctctccacgcagatacttttcataggatttctcgatgccttgcttgcctatatagtctccgcgaatataatagtcatcgttctcaatgtctttcttggacacttcgccgatgtctcccagcaaatggccggcagagttataggtatattggcggatagtacgccgctgaatatagaaacctggaaatttgaacagcttctcctgaaacacaccgcactcttcggcagaaagctgcgtcatgaacacctgatgggtgtatttggaataaccggggttcatccagcggttcttgacgtccttcatccgtttgtcaaactgctcacgggtaatgttcaaggcactgcaaaggtcgagtgtatccagctgcgtcacctcccgaggcacaaacgtaatatcataggcaggctggttaaacacgagcaacttaccgttacggtcgtagatagccccccgtgatggatattgtatcttgttcagaaaagcgttactgtccgcgttcttcttgtagtcatcagtcatgatttgcaggtcgaacagccggaacacgtaaataagaacgatgacaatagccgccgctccaattacatatttccgcttttccagtgtatagtctttcatcaattcctaatccttaatccctttatcctttctttcttattccctcaacagccataatgcaggtcacagtaagcagggtacttgccgcaattctcaacaacagcgtaccaatatgggcaaaagagaagaattcgagggtaagcaacaagccgtgatgtatcagcacactcacaaccagatatttcaggaaaggaagaatccccattgtacggatggccggaaccagtgtatccagcgtgtcacgaggcacgaacagccgcaagaaagtggggcgcaagaaagccagcaacaccgtagcggcagcgttcatccccggtgtgtcggaaaagacgtcgacagccagccctaaaaagaatgcccacaacatcaacgcattgcggggagtgtccgactcaaacttcagtatcaagtagatatacagaaatggagtggcatatcctgcaatatgcacattgttcaatatcagcacctgcaacagtaccaagcctatgaaccatcctattttatgcagataattaattaacaacgctaatgagttataagttacgagttacaagttattgagtgtataagttataagatataaaaatgattaatccttaacccctaatccctaatttcttagtcacttctcgtccgccctcgactccaatgtcttttgttcatcctgcccgttgcgggaaatgacgcgcacattactcacctttccaaagtctgtagccagctttatcttcaacagatacgaaagcccgtcgtgcgagtcggacatgtcatccaccgtccccaccataacaccttctggaaacacggtggaatagccgctggtcactactgtatctcccagattgaattcggcatgccggggcaaatccttcagataggcaaaacgggaatcacctccctcccacttcaaataaccgaaataatcactacccacaatcttacagctgatgctcgacttgctgttcagcaacggaatgaccaacgaataatggggagaggtcttatacacaatacccaccacgccattggcatctacaactcccatctcaggacggataccttctgttgttccacggtctaaagtgatataattgtcagccttgttcaagctgttctttatgacattcgccttgaatatctgatactccgtaggagcaagccgttccatgctgtacaacctggcggagtccaatcctttctccttcaaaacattttccagaaacgaaagccgctgctccagccacatgttgcggtcgagcaggtcttcgttggccgtcttcaagtggaaataagaagtgatgccacccgatatttcataaaccttccctgccacgccattggcagaggtgaaatacacactctgctggtaatgattgaagcgaaataataaaataaaactggcaacctctaacagtagaaagaggaaccagtaattatatttaatgagaaagtttaataaattccgcattaccgcatcaagaatgagaagcggtcaacgttcttcaatgccacgcccgtacctttggcaacggcatgcaaggggtcttccgcaatgtggaacggtatgtttattttatcagtcaaacgcttatccagtccacgaagcaatgcaccgccaccggcaaggtagatgccgttgtgaacaatgtcggcatacaattcgggaggcgtattttccaatgcactcaagatggctgtctcaatcttagagatagacttctccaggcagtgcgccacttcctgatagcataccggcacttccatgggcaatgccgtgatgcggttcggaccatgaacgatatagtcttcaggagcatcctcaccgagttccgtcaaggcagcacccacattaatcttaatacgctcagccatacgctcgctgaccttcacgttgtgctggcggctcatgtattcctgaatatcggcagtcaagtcgtcaccggcaatgcggatggagttgttacttacgatacctcccaaagagattacggcaatttccgtagaaccaccacctatgtcaacaatcatgttgccttcgggagcctctacatcgataccgataccgatggcagcagccatcggctcgaaaatcaaataaacgtcgcgcccgccggcatgctcggcagagtcgcgcacggcacgcagttccacttcggtactgcccgaaggaacaccaatcaccatgcggagtgacggagagaaaagacggttacggttgttcaccatcttgataagtccgcgtatcatctgctcgcaagcatagaagtcagcaatcacaccgtcgcgcaacggacggatggtacgtatgttttcgtgggtcttttcgtgcatcatctttgccttgtcacccacggcaatcatcttatcggtacgacgatccaaagccaccaccgaaggctcatccaccacaatcttaccattcgtggtgatgatggtattggctgtgccaaggtccatcgctatttcttgtgtaaaagagaataatcccatctattgatttactattaaatgatttactatttactatttggcagatctgctatctgacgacctccacctacaatgacacctcccggcaaatagtaaatagtaaatcgtcaaatagtaaatgaccttaatgtttaaagtgacggaacccagtagttaccatggcaatgccatgctcgttgcaatattcaaacgagagttcatccttgatgctcccacccggctggatgacggctgttacaccttcattgccggcaatttccacgcagtcggggaaggggaagaatgcgtcacttgccattacagcgccattcaagtcgaaaccgaagtttttggctttctcgatagcctgcttcaaagcatccacacggctggtctggcctacaccacttgccaacaactgctttccttttgccaacacaatggcattcgacttactgttcttcacaatcttgtttgcaaagagcatatcctcaatttcctgtgcagtgggagccttcatagttacagtcttcaattcttcaggaatttccaccttaaggtcgcggtcctgaaccaatacgccattcagcaaagaacggaactgcttcttaggcagagctgccggcttgcgaaccaggataatacggttcttcttctgaccgaggatttccaacgcatccacatcataatcgggagcgataattacctcaaagaaaattttattgatttcttcggcagcagccttgtcaatcacggcatttgtaatgagcacaccaccaaaagcggataccgggtcaccggcaagcgcatcgttccatgcttcgagcacagtgggacgtgaagccagtccacaagcattattatgtttcaggatagcgaaagtagtatccttgaattcgtcaatcaaatcaacggcagcattgatgtcgagcaggttgttataagagatttccttaccgtgaatctggtcgaacatagcatcaatattgccatagaaataacctttctgatgcggattctcgccatagcgtaaagtcttctggctgttggcagaacaacggaaagcggaaccttcctcgccatcgaaatagttgaagatggcagaatcatagtgtgaagacactccgaaagcctctttggcaaaccaacggcgttcttcgatggtagtagtggctccgtgttccatcagcatgtcgcggaacggctgatattgtgcttgcgaagcgatgataaccacgtcgttatagttcttggctgcggcacgaatcagagagataccgcctatgtcaatcttttcgatgatggcaggttcttcggcaccactggcaacggtagcctcaaacggatagaggtcaacaatgacgaggtctatttcggggatttcatatttttcaatctgttgcatgtcttgctccaatccgcggcggcaaagaatacctccaaaaaccttcggatgcaaagtcttcacgcgtccgcccaggatggaagggtatgtagtgaggtcttccactgccttgcagggataacccagggattctataaactgacgggttccaccggttgagaggaactctacaccttcttcatgcagtttggtaatgatttcgtccaaaccttccttatggtaaacagataccagagctgttttgattctttttgtttcagacatggatttgcgtattaaagtatgcgtatattagtatttgatgcgcaaagttacaaattttgtttattcatacatacattcatacacaataaattaggtataattaaaaaaggcggcatctgtttccagtctgccgcctttttttaagggttattttgttggtttaccaaatagatacacgtttttctaccggcaagaacatcgggtctttttctgtcacgttgaatgcctcataccaagcaccgatttgcggcaatgcaccgtttacgcgccattcgcccaatgagtgcacatcactcttcgtgcggttcaacacttcttcgggacggatatcattggcccatacacctgcgtatgccaggaagaaacgttgttcgggagtaagaccatccagcaccggcagcggattggcagccgtagctttcttgaatgcctgataagaaacctgcagaccaccgtggtcggcaatattctcacccaatgtcatgcgtccgttggcatatacgcccggagcaacctcgatgctatcgaagaagttcaccatcacctgagcacgctcgtcaaagttcttggcatcttcagcagtccaccagtctttcaggttaccgtccttgtcgtactggcgaccctggtcgtcgaatccgtgagtcatctcatgaccgattaccacaccgatggcaccatagttgaaggcatcatccgcattcatatcgaagaaaggatattgcaggataccggcggggaaacagatttcgttcgtagtcgggttatagtaagcgttgacggtctgcggagtcatcagccattcgtccttatccaccggcttgccggccttggctatcatttcggcatggctccactcgttggcacgttccatgtttgcccagtaagagtcgtttttgatttccagtgtggagtagtctttccaagtgtcgggataaccaatcttcacatggaaggtagccagtttctccagagctttcaccttagtggaatcacccatccaggcaagattctgaatacgttcgcccaagctttcctgcaagttcttcaccaaagtcaccatacgctccttggcagcagcagggaaatatttctccacgtacatctgacctacagcttcgcccagcgcgccgcttacagtgcttaccgctctcttccagcgaggctgcatttcttgtgtaccgctcatggtgcggctgtagaagtcgaagttctgttctgccatagcatcgttcaacaagcttgcggcagaatcaatcaatttccattgcagataaaggctctgctgttcaatgggcagcgtatccagaatatcggcagcagctttcagtgaagcgggctggcctacgatgatttccttcacatccttcaagcccatggcagacaaataagcatcccaatcgaaagtaggataattcttcttcaactcttccatgctcatcttgttataattggcatgcgggtcacgcaactccgtacgagagcggaaagccttggcaagacgtgtttccacatccatcaccacctccatacctttcttggcagtagcctcgtcgaaaccagccaactgatacatcttctgtacatgtgtacggaaagcatcacgaattttggcagtagcctcatcattctccagatagtattcacgttcgcccatgctcagcccggtctgataggtctgtacagcattcatgctactgttcatttcgtcagcgccaacatacagcacgttgtagacgatgatacctttcttctgcatatcgcccagcaaggcataaagctccttcttgtccttcaaagcagccagctggtcgagttcagccttgatgggggccacaccgtccttgttcagcttcacgctgtccattacgattttgtacaagtcaccgattttttgtgccacgctgccggcttcgtgctgggtggcggcaagttcttcaatcagtccttgaatctgcttgcggttgttttctgcaaggatagtgaaagaaccgtactgtgagtattcagcaggaatcggattgttcttcatccaaccgccacatgcgtattggtaaaagtcagttccgggtagagccgttgtgtcaagattggcgagctggatgcctgctgtaagttcagcctgctgcttgccggtgttgcaggatgccgtcatcagacagaatgctgcaatgggtaacaaatgatttgctttcataaatatataaaatataatagttagtgattctccaactctacagtagccgcgtcccactcttccatcacacggtcaagctgctctttcagtttttggtgctgctcataaagcgacatgtccgaagcaccctccggtgtagccatcctagcctcaagaatggcaatggcagcctccgtctgctctatctccgcttcacaatcggcaacgcggcgttccagcttcttaagtttcttgttaagctccttctgctcctcataggagagtttggcagccgagggctgagccggttctgcaccagcatttcctgatgccgccttaccggcagtgggcgaagcggaaagtgaaggagatttctgtaactcattcaggctctctatctgcttcttttgcaggaaatcataaattcctcccaaatgttccttcaccagtccgccaccaaactcgtatactttagtcgcaagtccgtccagaaaatcacggtcatgactgactattatcaccgtcccgtcaaaatcgcggatagcttccttcagtacatctttggaacgcatgtcaagatgattcgtaggttcgtcgagaatcagaaaattcaccggctccaacagcagttttatcatggcaagccgggtacgctctccaccgctgagcaccttcacccttttatccgaagcctcaccgccgaacatgaaagcacccagaatatcacgaattttgaggcggatatcccctacggccacgtggtcaatcgtatcgaatacagttaggttctcatccaaaagttgtgcctggttctgggcaaaatatccaatctgcacattatgtcccagtgtaagttttccggtataatccgtaatctcacccataatacactttacaagcgtagactttccttcgccgttcttaccgacaaaagcaaccttctctcctcggttgatggtcaaattcacatcatggaaaacaatgtgctcaccgtaggatttctccatatcctcgcagatgacgggataattaccgctacggctgctgcaaacaaacttcaggcgcaaagaggagttgtcttcctcatccacctcgatacgttctatcttttcaagttgcttgatgcgactttgcacctgcacagccttggtagctttgtaccggaaacgctcgataaagtcttccgtatcttgtatctgcttctgctgattctcgtaagcacgcagttgctgctcccggcgctccttgcgaagcaccacgaactcatcgtatttcactttatagtcgtaaatgcgtccacaagttatttcgatggtacgcgtagtgacattgttcaaaaaggcgcggtcgtggctgacaagcaccaccgcattggcacgggtggaaaggaagttctccaaccactggatactctcgatgtcaaggtggttggtaggctcgtcgagcagcaacacatccggacgacgaagcaacagcttggcaagctctatacgcatacgccaaccaccggaaaactcgcttgtagagcggtcaaagtcctcgcggctaaagcccagcccttggagcgtgcgctctatttcggcacggtagttggtgcctcccatcataaggaaacgttcgttttcgtgggtgaagcggtcaatcagtttctggtaatcctcactatcgtagtcggtacgttcggcaagttgctgattcatgcgttcgatgcccgcctgcatctcaaaaatatgctcgaaggcaagttcagcctcctgcatcacggtgcgcttgtcactgagtatcatcacttggggcaaatacccgatagtacattcgcgaggaacggcaacaatgccggcagtgggctgctgaatgccagccaatatcttgagcatggtggacttaccggcaccattcttgccgacaagagctatacggtctttcttattgataacataagagacgtcttcgaacagaggagtggcattaaattctaccttcagtccttctacagatatcatagtgtcaatgaatttatcgttcaagactgcaaaggtagcgattttcaacgttatacaatatcatacgctcacataattacatcaaatatccaagaaagagaacactactcccgcatttcctgcggaaggacaattgcaaagcggctccccttgccaagagttgaggccacttctatttttccatgaaacctttcaacgatagtcctgcaaatggccaatcccaatcccgtgccctgcacaaaagcatctcccttatagaaacgttcaaaaatgtgcgccagaacttcttccgacatgccagttcccgtatcttccacaaagacttccaatgtagcaaagtccttcagcctataccctatggttatgcgtccttcagcagtgaacttcaccgcattattgataagattgttgacaacttgccccaaacgcgtaggatctgtatagataactgccgcccggtccggaaggtctagcagtaactccactcctttccgaagattcatcttctgcgcactgtaaatgctttccaatatgccatttaaagaaaccttctcaaaatggaactccattgtgttcgattctatcttggacaaatccagaatatctgaaatcaacaccattaacaactggctgttcttttcaatcaaagacgtgaattccataatctcctgccgtgacaagtcggcatccccacaagccagtagtgtagagaagcccacaatggcatttagcggcgtacgtatctcgtggctcatattagcaagaaatacgctcttcaactcatcgctacgttgcgctttctgcaaagcctcgttcaatttattctccgtatccttgtatttctgcgtactcatgcaaataccgatgatacggaacggcaaatccgtcaattgccccacataggtagattgcgcctcaaaccactcccacttgccgtctccccgccgtaaacggtattccactgggcattcgtacaaattaccatgcaactgtaaagccaaagcatcaaacactcccttccggtcgtccggatgaatcagaaatgcgaattcctcaggcgtcagcgtatagtcacgcgtaggaatccccaaatattcaaaataacgcggttctataatcatcagattatgttccatgtcgaaagaccattgaaatatctgggtacgactcagcgcaatattcagcaaatgcttctgtgtccgttcttccaacacattcctgaaatagagtacaatcctcaccaattgtccatcttcatgaattcccaccatagcaccttgtatcagaaaacttataccactcttcaattcacgtataaagcaattggtatctaagggaataatccgcacatccctctcccgaagttgcagcaaaaggtcttctaacacattctttttatcacataccacctccaataagtcagtgatacgccgccctatcacatactcattcaattggagttcattcatcacctgctgattcagacgccagatacaatcttccaaatcaatcataataatgctgacgggccatgagttgaacaactgctcggagatggcatttattatacgtacttcttgaggaacattcggattcatcagaattggtttatcatacaagaagcaaagttcgggttaaaatgcttataccacaaacaaacccttataaatcaatattccattttaatatgtatatattctattattcacaactttaccttatttaacagagataagttgagcgtaatattgattttaactgttacctctgtcatttatacattattatcccccatttttgcgtcttaaaatctccaacatgaatatatccgaattcaatataaatgacgagttcattgcctgcaatcatatcacaaccagtgaactgaatccgctagtgaaaaagccataccacaccaaggccagtatcttcgttttgtgtatcaaaggagttctgaaaaccatcataaaccatacccaattcaaggttgaagctaacgttctcctagctattcctcctgagaccttcgtacaattactacacacgtcagacgatactgaaatatatgtcgtcatattttccaaacaacttatccaaagtgcaggagtcggtaaggtcatgatggataagtttcacattataggtaaacactatatttttcctctatcgaaaaagaacttccagctttatgctgagttcatgacctatttgtcacacctctatcaaagaacagaaagcccctcaagtctagtttcattgcaaactctactggcatatctgttacaaggcatatccgaactctgcccggaacaccctaggataaaagagactccgggcagcaggcatttcaaccaataccgcatttttatccgattggtacacacagactatgtccgggagcatcaagtgtcctattatgcattgaaaatgaatatgaggccggcagctctttgccgccttgtcaaaaaggaatcaggacatacagccatggaaatcatcaacaatactatcatcatggatgccaaagcacagctttgtaccgccaacactccgataaaggatatagccgtgagtctaggttttaataatgcggccttcttcaacaaattctttaaacgtcatacgggaatacctcctcagaaattccgtacatcctcaaaacaataaaatctactcaaaacccaaaatgcggatattctgtcctgagaatacccgcattcctcaataagagaagtccgtcatcagcctaccttcttggcaataaagaacacataaccgtaaaattccttatacttgccgtacagttcatcctcaatcatttggagtaagctgaactcttcggcaattttattaccggcatatttcttacggaaaatctcctgagccgcaacctttgaagcaaagtaatgctctgtccagcaattctccggcaaaatgaatgtagcaacgggaagataacctgccttgtacaacttggtcacctgattgggaagtgtatccatttcagagtaagcgtccatccagaagtcattgatttccgcagggcgttcgtccgtaaaccatgaactctcggagacggcaatataccctcccggtttcagatacttacgccactccttcaagccacgttcaaagccaatgttatagatagcaccttcacaccaaatcatatccagctcctcctcaccgaaaggaagggcatccattgaaccgacaattccttttactctgtcctgcaagcctaactgccttgcattacggttgaagatatcaataaagccgggaaaaaggtcaattcctgtaatccaccccggcacatggccagctactaccattgtctggccacccgttccacagccgatatcggcaataaaggattcatcggtaagaccgtctacaaagctcaatgccttcaacgtcgcttcaggactgccagggccttgtcgttccatattggagaaaaagtcacagattaaattaagttcgaaatcgtggatagttttattttcgttactcattttcttactatattttgcatatacggaaagtatcacaataccttcagcataatatgcggattaaacttgaattataacaatagaaaaacactctcgaaagaagttatccgagagtaaacgaaggggggacaatctgtgcagggaacacagattgtttacaaaaccaaatccgatttaaatgtctttgtcatactgcaaagatacgcaatattttatttaatcaaagattttacggttaataaagattttcccttgcaccgggcgcatgctgaagaaccgcacctaccacctggcaagtatccagttccttacagtcgccgcaagtattgaaacctttttcgtacacacatttgcggatagcacaataatcgctgcaataggcaaacttcaccccgtctgcacggcaccccatacaatggatggtttccggcgtaatttccggcgtattgttcagcacactccactctttggcagttttctctctcagctcatcgtcattattgacagtggctatacgggcggcgcaattttcgcaatccaacccgcaacatgcaattaattgtttcatcacttggttataacgatttatgtttgaggatataatgccctttttcccgcacatcgattcagtaagcccaaaactcaccccataccttggaacagacactcatttaccgacagtcctcagcgttttcttaacgatatacttggtctctttcgtttcactttcccaacgcctgcaaagcttccttacaaatccggattgcgtcttacttgcatcatttaaccaattccctacgctgttccgggcatacttggagtaatctgatttcaaaggttccaatatcggtaagcccaatgcagggttctgttccaacatttcagtatgcttgcaccagacacctcgtgaacagaaaacagaagaacaaatatagctctggcaaacgccttccccatatttgtccttttgttcttttacccaataaattaatgcgaatcaagttatccttccgtcttactttagaacagcttcgcaggatactcacccgcatccaccaaagcctgaatcttgtcgactacactctgacggtcttcgggataagtcacaccgaaccacttgctggttgtatcgagcacttcgcaggtagcagtgccattgttaatcagcttatccaccatcagcgggatgaagaattcgcttttcagattctccatattcttcgggtcgctcaggaagctcttgaaaaactctgcactgtaagcaaagtaatcgggagtaaagccccagaagttcatgctgaccggagtcgtctcgggagtggcagtccattcaccgttatcatcgatgtacttcacctcgccgtccatacgctgaatcttggtacgctctactacagaagtcaacaagttgtttgcatccgttccgcacaaaccacgggatacggtaccgctttcgctcaatgtattaccgatgcggaagcctaccatggaatatacatttttggaaccttcgggaagggctgcaagaaatttgcccattacctggaaggaatcacgaccgtagaaatcgtcgcagttgataacagcaaacggttcctttattacatcggcacccatcattacagcatggttggttccccaaggtttggtacggccttcggggcaggtgaagccttcgggaaggtcatcgatggactggaataccagttcgcaggggatatggccttcgtatttggaaataatcttgtcgcggaaatcctgctcaaaatctttacggattacgaaaacgagctttccaaaaccggcattgatggcatcgtaaatagaataatccatgatagtttcgccattcgggcccagtccgtccaattgtttcaagccaccataacgactgcccatgccggctgccaataagaataaagttggtttcatatttagttattatttaaaaaggttagtatatcacagttgataacggctgcaaatgtacaaaaatttatggctgacagaagggagttttagttcattctttaccactatccgttcaaaaaggtacatttagaacggataaccgatggcaaaatgcaacgccatgctgtccttgaacttgggaatattataataccccgacttcccggtatcatacggatcatgcagcccgatacccaagtccagacgaaaaacaagaaagtccaaatcgtaacgcaagccaaatcccgtgcccaaagcaatctgtttcgggaaattcttcaacgtaaattcaccattcgggcggttttcatctttacgcatcagccatacattgccggcatccaagaatacggctccatgcaagtcggcaatcatacggaagcgatactcgatattggcttccatgcgaatatcacccacgtggttgatataggtatatttcctatccgtctcgggaggataaccgcccggacctatactgcgtgcagaaaaggcgcgcacactgttggcaccaccgatatagaactgttccgtataaggtgcggtcgtagcgttgccatacgaccatattacccctcccgcaatacgcgaagcaatcatctggttcttgtctatccggtaatggtacctgaattccgagttcagcttcaagaactgtgcaaaaggtacaccgaaaagcttcttcccttcctcactgaacggcttgccgaaaatacggtaaacagcagaagtcaggttaccggccgacgcaacggtggtctgccaccagatggggttacgcttgccgcgcacggaagcgttgtcataagtataggtgtactccatggcaggaatgaactggtcgcgcaaactaacgtagagtgccggattctcggcacgcagtgtatcgaaagcggcagtaggattgcgcagtacattgaatgtcaaccggaaaggagttatactgtgcctggaagtcgatttgggctggaagtcataagtgacattaccgccaaaagccaacagcttataatacttggcacggttcatctggtcggcatacaaacggaaagtcgttgtagccgggaagtcatactcacggtcgcccatcctgggaaacaccacgcgcggaaagataagcgaagtggagatacccagttcatagctgttcatcagagaagagcttgccttgcccgtctgccattcgtacgaaccgttcaacttcacattccagctttcaccgccaccgaagacattattcttcgtcaccgtaaaagcggcacccggtcccgtctgattattgctcttcatagtgacattaaaatccaattccgcatcgtagggtttatcgagcgcggcaatgaccttcacatccaatgtatcagacacaaatgccgtatcacgcggtatatactgcatctccgcataacggaaaataccgacgcttgccaggcgctcctgaatacgggtttgacgatataagctatacaaactctgcatagaacgctggcgggcaatacctgcgctgtcctgtatctgacgtttccgccgataaccttgatagttcaaccaacggtaaagcatgttgggacgtaccggtggtttgttgtagtaatgtatggtcaagcctttgtaatccatgctgtcattgggttcctgcccctgctttccaagaagatagacggatttacgccccacacgaaactgcttctcggctacctttggcataccgggaacgggaatcaagcgcatctggacatgcccattgggaaccatcatggtatcggcctgataggttaggtagtcgggacggaaataataacagcccacattacgcagcagggtactgatacgggtacgctccccatccagatcagccacattgaattgttctcccggactgataagggaacgtcggcgccccagctccataatgcgagtggtacgttggttgaaaccacgatagtacaccgtatctataaagtaaggattacgcatgttcaccgtatattgcaactttgccttcagcgagtctttcgggtcgataaatgtcttgtagctgacgcttccgttgaaatagccgtaatcgcgcagcaagttaaccgccgccttctgacgtatatcgggattcaccgtagacagaagcaccggagtggcggcaaatttattgaatatccactttccgagtcccttctcatacttctggaaaccattgtaaatccacagtccgaaaggaaagggatagcggatagtagagctccccagcaacgaattgttcggtgccgtagcaagggcggcttccacctcttccatggcaatctcgccaacagacgtttcactgcggttcaatacaatcatcggcttttgtccggtatagagtatctccccctcgggcaagtgcttcgtggtggagcaacctgccagaaatatcaatcctgcaatatataatatcagtcgtttcatatcacattcctactttttcatatcgctgttttcagcctccggttttatctttttcttcctgaagatgaagagttcacccaaccggtccatcttccggcgcagcacaaggccaacacccgtttcggttatctcaccgtcgagtatgctttcgtagttcttattatggaatacacggacatatcgggtacccgacgcatcaagacggtattccagcgatatattgtcaatgaatgattccgcatcgttcgtcgcattggccccggtggatacttttccaccgatgactatctgtacgcgatcgttgaagaaacgctgggaataacggaaactgaagtctttctgcgtgtcgcccgtttcagcagaggtacggtcttccacacctacactgatattggcaccttttatacctcccgccaaggagtttatctggctctgaagcactgagttcaaggcggctcccattgacaaacctcctcctttggcgccgctattcaagtaaatacccgtagcaagcatcgcaatagcctgcttactacgctcttctgcccccattgcctgcagctcattctctactgtgccatcttcgggcgccgaaatatcgaatataagatcgggagcgtcaagcctgttcttgatggaaatggaaacatcgaagttcaccatgcgcgaaccgtccccgtcaccgtcggccacagaagcacgcatacgttccgtagcctttaggcttagcgtaggattcataatattccctcgccaatccacataactgccgggattgaactgaaactccttcaaggggatgataggcagcgaatatttcatgacgccacccgaaagggtatagcgtccggtaaggctcatatccccttggggagtatactgcatattcaaatcaccgccaccttccagttcgatgtatttgctgcggtcgggactcaagtcggcacgaagacggacagcatcgtcaatatggacggacatatacatttccaatcctcccaacgacatggcaggaacttcatccgcctttaccgacgtcgtatcggtgaatgaggtaaaggtaaccagcccactgagacggtcttccaccgttaaaggggaatcggtcaacacgtaggttacgttggtattgcccagcagattcatgtttccacgcatcgtgagcccgtcaagcggtcccttcaccgtggcatgcaagtcaacgaacacctttccatataccagactttcgcgagtacgcggtgcatccagcaacgtatagttctctgccagcagattgaggttggcagtaggacgctccatattccggaaatcaaccttaccgtcaatcgtaaacggattcttgctggtggtataaatggcaaacttatcgaatatcaactgattgtcctttatctgcaccggacggttgtcgaaccagtaacgtgctcccgcctggcgtgcatagacagacacactgtccaaaacaatatcaccatgcatttgaggcttatccagcgaaccgtaaatataaagccctccatcaatatctccggtaaaggccaccatttggtcagggatgaatgcattggccatcttcaatgggaaatgctcgaaacgagtggacacttccagagtatcctttccgttcttctgcgtcaagataccgtcggcggtcatcacttcttcgttatcatgtgtaaaataggtattcaaatagtgcgtattcttgtcgcccggcaaccaggtagcccccagacctatatctccaaccggttggcgttcgtaggtcagtttctctacattggcttcggcggacacctgcagggaagtggcagtctgtatataatttgcttcggcggagaacaatcccgtaagccgaggcatataaggaagtacctccgtaagttcatccaggcgcaatcggctcagttctacgtttatattctgcaaggaaagggtatcattcttgtcggattgcatacggaaacacagaccatcgtcgctgtccatatcaatattggcatagacgcgcatattcttatgcagataaatccagttactattgtccgcaaagtggaatttacggaaagcgataatcggctcggcaggaataaggttcagcagcacaccatcaccgcgaccatgtccttcggtcaacggacgggcgttaataccgaacagcacaccggtctgcccttttccatccacataatccacagtcagctccgcatcttcattacggacttcacccgtcagtgtactgcggaacacaaactgcgggttcttggggccgtttatgacaccaccttgcaacttcatgcgggcagtatcctgctttactgtaaaaaatattgtatcgagctgcaaggagtccatgcgcaatccgtgaacagctgtacgcccattgatgccgacttgcggagtaaatccgaagctcagtttgaaatcattataggaaataccctttgcagccaggaaatagctgacgggattctggttaccggcttccagatgcatgccggctgaaggaaggacttgtcgcaaagcggcatggtccaaacgccgttcatcaatctgctttgtcaggatagagacaaatttatccgactgttccatcaacttcttcaacgtgctatgagcgcggaaacgcagattcaagtcaccggcatcaagcctcaactcgagagaatcatgacgtgcctccgctcccattgtaaaggcaaatgggtgtttcaacggtcggggcaccaaccccagcttgtgcagattcacctcttccacattcaaatccaaagcgccatccagatagctgcggtcaagacgcatatctgcatttccctgcatcttgagaagaacattatcgctggcaagacggacagtagcaacggatgacttgagtccggcatgcacatccacaccggaaatgtcccaatggccatactgtagtttttccaaggaggcattcaaagcagccacagtctttcgtgatgccacatccaccccttgtcccttagcggacatctttaccgtaagagtataaatagagtccttgggcaggaagtgatgcacctgcaagttgttgatggcaaggtcggcatggtaggcttccgtagcaagattataggcggcatccagattcaaggcgccttccttctcctgcagtttcagggcggcagtgcactgcgccccctccataccgacacgtgccgcaaggtgcatactgtccggcacgatgacggagccatcgggagcaatgtcagctagtccggtcaggaagttcaagttctgcgtatgcatctcgaagtccatgtttccattgcgtttcacactgtcggccaggttccagaattctcctcccccactcaacgaaaaggctccgggcagctcagccgtaaaacgggaaatctgcatctgcttcaggtttccttccgtaccggcatgaatcaccaacggacggaacggataggcttccttgaaagtttccggcaggccaccggcaaaaagcagtacatcctgtttgccgatacgggcattgaaacgggctgtcaaacggccggtggtaggtatatttatcagttcccagtaagtctgtgccgtaagattcatctcactatgaggtgtcagcaacttcaaagaagggatacggataacggtagagtcggcaaacaaccgcccggtcagggaagttacactcaaaccggaacgctcatacatggaaaattcccggataacggcattcatatctctaccgtagtacatcacagaatcaatgcccatacgaatgtcgtgaagagcaatgtgcgaggggtcgaaacctatcgcactccccgggccgccggtatcataattgacagaagttccagtcagcaggaattttctccagccatagaactggtgtttcaggtcggcagcagcgtccgcaatctcagcatttccgatatgggctttcagccccatggagtccaatggcatctgtaaatcgaccgagacgttcttcaacttcagggtatggagtgtgactttccagtttaacgcagtgtcagtagtgtccttggaagtctcagtggtatctgcaagcattacctgcacatgggtatcgctcaattctatattattgagaatagcatcttcttttgtaaggtctatgccatggctttcgaaaaagaaatgccccagtacccctttgatgcacataccttccattaaattggaagagttaacagcaacttgtttcagggtaatgtcatccacctccactttccctttgagtaaaggccatgcctgcacccgcacgttcaaacttccaagattcagcaaagtatcgggatgctgcacctcaacagcactgtcggcaggctgtaccaccaatacaccgcgaaccaacaaattcaaaggaaagcgaaggtcaatccgctccacagatatgtccatacccgtagcatctgatgcaattgctgtagcctgcttccgtatcaaattctgtacgggaggcacatagagcagtatcatcaatattataaacagtataataggagtaagcagcacccacagtgctattctcaaccattttcttctcatcggaacgtcaatctttcatcgtatttaaaagtcctacaaagtaaacaatttctttcgacatttggttcccgatagagaaaaatcatgtattcttctctgttcccccattacggaaaagctgttgcctgagtaatgacatcctctatcaaaacgagggcggcaagggcgtgctctttcaactctccggtaaaaggcactccatgcgaagtttccaacagtttcagcaatgcaaccagttccgtagctccaatcaacgtaaagaggggaatcattttgtgggagacagcagccatctcgtccacatcctcattctccacagccttctgcaaacgctccgcattgagacgggtttcagccacaaaactttccagaatggactttgcggcctcggggtcatcgaccgaaaaaacggtgagcgaagagaatttataccccgggcaagccgaagcttccgtaacctccttccctttgtcctccacattcaattcatgcagcaattcactgacggtaaacggcttatgcaggcatccggcaaagccatgcgccgtaaattcctcacgctgcatgtcactgcgagcagtgacagcaatcaccggaacagactgtgcctgcggtatgttcgaagcacgcagcagtttcagtaaatcaaaaccattaatagcaggcatctgcacatcagtaagcagaacatcaaaggttgcagtgcgcaaggcatccagcaattcatccagttgtaaacaagaaacagaatttataccactctgctgaagcatggcggcagtaagggtaagttgaatacggtcatcatcgataaggaggacattcttcaatgaagaacaaggaacggagaatgaagaattgccctccggcgtgacaacacagcccaattcttcatccttcattctacgcctttcgctccttacgggatagataggaatatatatcgtgaaagtgcttcccttacctggtacactgtctacatcaatcgtaccttcaagtaactgtaccaacatacggacgatggaaagtccgagtccgaacccttctttaccctgagcacccggtaatcgggtgaattcctggaagatacgctcacggtcagcaggctccatacctctacccgtatcagcaatggcaactaccagtcgacggtcctcgtaacgggcagtcatggtaataccgccttggtccgtaaacttcacggcattggacagcaaattgttgataatctgacgcagacgcaaggggtcacaaatataggtaccgtccagctccggggcaatgtcgcaatgaagctccagccctttggcagccgtaagcggttcaaaacttacgtgtatctcttcaagcaggcgggaaggatgaaaagtgacccggttgacttcagccttgttcaaatcaagacgatggaagtcgagcaaatcaacgaccagcttcagcaaatgctccgatgaggttttcatgttgtccagatagaaccgctggcgctcatccaccgtcagacgggaaagcaaatcggcatagcccatgatagaaccgagcggggctttgaaatcatgggtaatggcaagcatcagtttttcacggacagcaagtaaatcttcggcacgacggcgagcctcttccaactcacggcggtaccggttgcttcgggttatgtcgcggccgatgataataaggaaaaaaacggaaagcaataccgcacctacggcaatgccactgataatcttggccgaacggcgtcggaccgcctgttgatactcggcttccgtccgtgcacgcagcagagtttccgtctcataatctttcagcaaactgtcaatacgagcggtcagcatatggtccaagcgttgcagatagcgtttacgtcgttgtataacagtgtttacagcttttttctgctgggccacagcacgcagtttctcatgcaaagaatcggccggattataaggttcaatcaccgtatccgtcgcaaattcgagggaggtctttacctggatagccgtatctttctttggggggacaaacacttcacccaaacgacggaaaaaacccttcttccgagggcgtgtcacgacggtatcccgatgtgtaatgatacggtgctgcacacgttgctgggtcactactgagtcctgctgggcaattatctgctcaatgtcactggtggataccatgctgtcattcgcctcactcagcgtacgcagcattcttatcgtattggtatccttctcgcgtatcaaagctagtacgctgtctgtccattgtacatcgcggtcatcggtaagaataaggttctccatctcccggtgtacgaagaacaaggaaaaaaacaataccgccagcaacaaagtgtagcctacggcaatctttactttggagacactgttcatattatcaaatcctttccctggtctgtctacggaatctcagccacagcatcacccctgcactggtcagtccaaacgggaaagccatccagacccccgtcagtccccagccgaagatgaaaccgcagaggtaccctacgggcaaagatataacaaaataggatataaatgcaataatcatcatcggtttcacatccgagataccacgcagggcattggcaaaattaatctgcaatccgtcaccgaactggtaaatcaggaacggaaagaagagagcggctaccataccggacacttccatattatctgtaaaccatcctccgacctgaccgcgaagtgcaaagacaatactcaacagcaccacttccatgcataagatgacgtgaaggccagcatacgccgaacggcgcacattctgcccgtcgccctgccccttaaagttactgacacgcacagcaactgcagcacccatgccataatacatcatgaaggtgaactgagagacagtgagcattatctgatgtgatgccagagcaagtgtccccagccaccccaccatgacaacactgaggctgaaggaagcggtctccattcccatctgcataccgacaggccagcccagagcattgagtttcctaaacatcggtgtcgaccatcccagcctcatgaatccgagtctataacggataaaacggcgactacgaagcacaatcaccgcaaagaccacgaccatcacaatgcgagagaacaaggtacttacacccgcgccaagcaatcccatctccgggaaacccaattttccattgatcagaatatagtttcctacgatgttaagcgcattccctccaagcagaatccacatggccgtcttggtgtcggtgatgccatccgtaaactgtttaaagccgttgaacaacatgacaaaaaccagtgaagcaagcagcactagataataaggcttaatcagaggcagtaattcttcgggctgccccagccgttccacattgaaatacagaacagccatgacaagagtcagcaataaagctaccagcacattggccaccagactgcaccgtaacgcttgtccggcttcggcaaaacggcggttaccgtagaagcctcccacaaccggggtcagcccgtagctgaaccccgtactgaaaataatacagagagtaaacagattgtttacgaaagaagcggcacccagctcttccgtgctatgatgcccaatcatcagcgtatcggcaaaccccagcacaatgactcccaactgccccaccacaatgggtagtcccaggagaagcaatgctttgtagtgttgcttatacgtatcaaataaatttctcatactaaaggttttctttttggtaataaagcacaatcccattttcatcgcggaaggtctgttgggctaccctatgaagctgttctgccgtcacagagcggtaattgtccacttcacggtctatgtcttccgcctgcccggtcagttcaaaccaggcaaggttcgtggcaacattcagataattgatgttgccgaatatctgtgtagactcaaacttgttctttactttctccaattcctgctctccaacaaacccggatttcaactcttccaactctttccggacagcagcctcggcttgctccaaagatacgccagcagatggctttccactgatatgcagcagtccggcatcccgtgtaccggagatataggcatcgagactggaaaagagcttttgctcctgcaccagcctgcgggtcaagcgactggaacgtccattgctcagaatatccgacagaatatcgaaggcataataatcggcatcttcacgactgcacatgtgataagccatgaacaaagcatccagaggaacattccgttccaccgtctgccggcgttccgccgtctgtacaacttcttgcggtaattgtcttacaggcacattcctacggggaataggagcaaaccatttttcagtcagcctaatcgtttcttcccacgaaatatttccggtaacggccagaactgcattattaggtgcataaaaacggaaaaagaattcctttacctcatccagcgtggcattggcaatgtgagagaggtctttcccgatagtaggccagcgataaggatgcgtttgataagccaaaggacgaagcagatgccccacatcaccatacggctggttcagacaacgttgcttgaactcctccatcaccactgcacgctgcacctcaagactttgctcactgaatgccagttccagcatacggtcggactccagccagaagccgatttccacattcgattttggaaccgtcaggtagtaattggtaatatcattattggtccatgcattattctccccacctgccagttgcaaaggagcgtcataatcaggaatatgcaccgaacctccaaacatcagatgctcaaacaaatgggcaaagcccgtatgctcgggatgctcgtcacgggcacctacgtcataaacaatattcaaggcaaccatctgcgtgctggtatcttcattgtgcaccaaccgcagaccgttgtcaaatatctttttgtttatcttcataaaatagaatgacagaatctatcatcaatctatcactgtcacttttttaataaccacatcctcttcaggacggtcgttacgatcagtcttgaccttctgtattttatcaactatatccataccttccagcacttcaccgaatacggtatatgcaccgtccaaatgcggagtaccacccatggtagtataagccttcacctgctcgggagtaaacttgaactccggttccttggcaacctgagcctctgcctgcgcaatcaaagaatcttgtaaatccatcagaccgtcctggtcattattcttacgcatcttgtagatttccttcatatgcttctgggccaatgcattgaaagcattgttcaggcgcatctgattcatctgctgttccatccccagcaaggtagagtcattatacacttttccagtcacaatgtagaactggcagccggatgatgccttgtcgggattcacctcatcaccctggcgtgcagccgacaaagcaccttttttgtgaaaatacttcggataaacaaattcggcaggaacagtataacctacgtcgcctgcccccagcatcttgccttttggagcctttttcgattccgggtcacctgcttgtatcataaagtccttgatgacacggtggaacagcgtaccttcatacgtgccgtctttcaccagcttaataaagttatcacgatgtttcggggtttcattatacagtttcacggtgatgtcacccgcacttgtttcaatcttcagcttcgtttctttttccatattttcctctttcttttgtcccggcttgcaagcagtcaaaccgcaaaccagtatagttaataatacaattagattccttttcattttattttttatttaatttaagtttgcaaatatactaaaatcagacaaaagcacttacctttgcctacataaaagagataaaaggcaaaagcaatgacatccatattaattgtagaagatgatattacttacggcatgatgctaaaaacatggctcggcaaaaaaggtttccaagtaacctccaccagcagcattgcccgtgctcaaaaacatattgagtcggaaaccgtggacttgattttgtctgacctacgcctgcccgacaaggatggcattgacttattgaaatggctgggcgaacacggcctgcaaataccgcttatcatcatgacgggatacgctgacatacagtcggccgtccaagccatgaaactgggagcctgcgattacattgccaagcctgtgaatccggacgaattactgaaaaaaataggcgaagccttgaatgcatcatcctccgctttgaaacagatgatgcatccgtcccgaacagatgacgcgtttaccccaaacagaccatccgtctcgcccaaacagacgatgcattccgacaagatgaaaaatcagtctcagaagagtgcagaaggctcattgtcttcctccgacttcctcgaaggagagagcgacgcagccaaacaactctacaattatgtgaaactggtttcacctaccaatatgtccgtactcatcaatggtgccagcggaacgggcaaagaatacgtagctcatcgcatccaccagctcagcaagcgtgccgaccggccgtttgtagccatcgattgcggttctatccccaaagaattggccgcttcggaattcttcgggcatataaagggcgcctttaccggcgcactgaccgacaaaacgggcgctttcgtcgaagccaacggcggtaccatcttcctggatgagataggcaatctgagctatgaagtgcaaatacaactgctgcgtgctttgcaagaacgcaagatacgtccggttggttcaaacaaagagataagcgtggacatacgtctggtatccgccaccaacgaaaatctggagcaagccatcgaaaaaggaacgttccgtgaggatttatatcaccgtatcaatgaattcaccctgcgcatgccgcaactcaaagaccgccgtgaagacatcttgctctttgccaatttctttctggaccaggccaaccgcgaaatggacaagcaactgaccggctttgatgacaaagcatcccgcgccttattggaatacccctggcctggcaatctgcgacaaatgaagaatatggtacgtcgtgcaaccctgctggcacaaggcaaattcattactatcaacgaactaagtgaactgaaagaacctgcatcggccatcatcggcatccctctccgcaatgaggaggcagagaaacgtcaaatcatcgaagccctacggcagacgggaaacaacaagagccgcgctgcacaactgttgggcattgaccgcaaaacgctgtacaacaagttgaagctttataacatatccgactaaaagatgtggaataattccacactcctctccacacattccccacttttccacattatactacactttgcataaaaacatatacatctagttatcaaagcattacccaacaaataattcttttggcacaccatttgacttgtattaagtacaagcaacaagcgctacaacaaacaattagacttaacaataagatatagcaacctaaaagcaaatgaattatgaaaaaattagtattagtagcagccctgtttatgtttgtttgtggcggaacgttcttggctcaagctaaggctccggtagaacagccgagtaagacaacaaccttgtctaacgacactgtggtaacggatactttgcagaaagccgagaacgtccaagacacagcaaaagtggcccaataacagtaagcacactacaacaaaaagccgtttcctccttgtctattctgggaaacggcttttttaattgatagttgatagttgtcaactaagaaatcaccaatgtctttccggataaaggtcattccaccatgccggactatcctgcaaccagcgggcaaaccaagccataattgaattgtgccacaattcacgttttgcataatcaagtacaaaatggttttcaccatccacggtaataaattccaccggcttgcccaatatcttcaacgcattatacaactggatactttcaccgataggcacgttcgtatctaccgtgccatgcagcaacaacagaggggtattaatcttgtccgcattgaacaatgctccatgcttcgtaaacaaatcgggattattccaaggatagctatcggctgccgcaacagagttataggaatatccccaataaccctcgccccaatagctcgttacattgctgatgccagcatgcgaggcagcggcagcgaacatgtccgtcttagtctgcagatacatcgtcatgaatcctccataagaggcacccagacatccgatacgtttatcgttgacaaacggatgggctgcacagaatttcttcgtaccttcaataatctcatcggccgtacgctcaccccatgcattgacatggcgtgcagagaactcctggccgtacccgatggcaccactgggctggataacataaaccacatagtcacgtgacgcaaacaactgtgcacagtacggggaagttataccgcgggttgtaggagtcgttcctccataatagtatacgataagcggatacttcttgttcgggtcaaaagacggcggcagacaaaccattccctttatctccgtaccgtccgaagctgtaaagttccactcttccatctgtcccagctcaatcttatcgaggatgggcttcatggggttggcaagcagggtagaaacttttttcttcgtgtcgtacgtataggctacgcccgtactggtgtttcctccgcccacataggcagccacaaccggattgtcattggccagcgtgaaggaagtaatcacatcttcttcaagcggaagcatttcaaagccgcccgtcttcggaacataacggtagatatgcctgcaatccccatcagtcgtatcgaaatagatacatccgtccacacggttccactgcacgagagacaccgtaggattgaaatcgcgcgtgatagcctgcactttttttgtagccaaatccataatgaatgcttgggtatcaaagtcattggctatgggatgttcaccgcaattcttgccaatacctccgaaagcagacggactacccgtcaccagaagctgtttcccatccggagagtaagaagcacttcccagataagcatcccaggcgaccagcgtatctgcctgcaaggtggccaaatcaatctcgaaaagagaagagagggagaaagggcattgagtaatgtccggcttggaagtgctgcacaacagtttcttgccatccggggaaatatcattcagatagacgttgtgactaccgtatgtcaggcgctcggaaagtcccgtcgccacatcgtatttcatgagataatagcggtcacgagaattggggatacggtcgtccggatgcaagagacgtttcaacgggccactcaccttttcgccctcgtccgtgagcatatagataagatagtcttctgtaggagaccagctgaaatatccttcgggaacattcttcagcagcacttcctcacgcatcgtggcgggatcgaacacaaccaggtcattctgctcctcgcccataaccgtataatagagcttgttgctgttgggcatccagttcatcttttcattggcattgggcaatatcacccggccagtctttacctcggtcagctcacaacgggtcctggaacgcttcacgtcgtaattgtccgaatagcgggtcagcagatacttgccgttgggcgaaagagaaaccctgctcgctcgggagccgaaattggtgttgaacaaagagaaacgtctcttcatgtccggtgccatccggcaggctacatcggcaaagtccttttccttttcaaattcgcatttcagcatcggctgcatcttgtcgtccgcgcttgaaagcaacttgatgacaatctcataatctgcttcggggtccatacgcagactgacagccgtaggacggacctgcgacaagctgtcctccgctgtctccttgacttgcttggactcaccgtttacaaacacctcaaaacgggcaggggaatatacattcagcttgcccttcatgaaacgctccgcacgcagattggtagcaaacagatagaacagattgtccttgtctgcctttgccacagctacatatccagccgtatcagcagccatgcgttcgtacgaaccctcgtcgaagttaagactgaccttcgtcttcagaagattgccgatagtaaacttatctcccttgaagttgacgctatcaccctgaaggggagtacgcaccgtaacggccggacgcacgttatactcagcaactctttcctgagcttgggcagccaatcccgcaaggagcagcaaacccgacaaaactgtgattttcttcattactgtaagattaaatcgtttcaaaaccattccataaatttccgggagggacgggagcctccacttctatcagttctttggacaccggatgcacaaaacggatataccgcgcatgcagacaaatgctgccgtcgggattggagcggggcgaaccatacttcaaatctcccttgatgggacagcccatctttgccaactgacagcgtatctggtgatggcgtccggttttcaaatctatttccaacagataatagttctgcgaccgcccgatgagccgataatgcaaaatcgctttcttgctgcccggcacctccttgtcgtatgcataactcttgttctgtttctcatttcgcaccagatagttcaccaattccccctcttcctcacggggcaggttcttcaccactgcccagtaagtcttcttcacctcgctattcttgaacatctcgttcagacgcgacagtgccttactggtcttggcaaaaacaacaagaccgctcacggggcggtccagccggtgggtgacaccgataaagacatttccaggcttgctgtacttctctttcagatactgctttacagtttccgaaagcggtgtatcacccgttttgtctccctgaactatctcggaagcggtcttgttgactataatgatatgattgtcttcgtatacgacagtcatcgattgttaatgtttaatgattagtgattaatgattaatgactaacacccaacttctcattaaacattaatcactaatcattaatcattaaattacatattcatcccaccatctacctgaataacctgaccggatacataagaagacatatcagaagccaggaaagtagcgatatttgccacgtcttcgggtgtgccgccacggcgcaaaggaatcttcttgcaccattcagccttcacctcttcagacaaggcgtcggtcatggctgtcatgatgaaccccggagcaatggcattggcacggatgccgcgagagcccagctcctgagcgatagacttggccaaagcaatcataccggctttggaagcagaatagttggcctggccggcattgccgtgaacacctaccacagatgccatattgataatgctacccgccttctggcgcatcatgatgggtgtgcaggcatggataaagttaaatgccgatttcaggttgacattgataaccatatcccattgctgttcgctcatacgcatcatcagaccgtcacgtgtgataccggcattgtttaccagaatatcaatacgtccaaagtccttatggatttctgccactaccttggcagtgtcttcaaagtttgctgcattggaggcataagcctttgcctttactcccaaagcttccaattcttttgctgtagcctcggcattttcatcaatcaccaagtcagtgaatgcgatgtttgctccttcttgagcgaacttcaaagcgatagccttgccgatgcctcgtgcagcacctgtcacaatggctgtttttccatctaataatcccatattattttaaaattatttataaaatgtattcttacttctttcccaatgcaccaagtaccagacgggtcacgtaagtatcgcgtaccgcatcgtccagattggctcctatatggccgcggatataaggtgtttcaatacctttgacactgtaatgcacaatctcagcagtcatatccaagtcatctatctggaaaacacccttctccatgccttcacgcagaacctccttgaaaagctgggtctctgtagcatcgaaacgtttgcgcactttctccactctccaaatatcccgaaagaaattggcacgaagagtaccattccgaaagacaacctcttttaccgcatccagatgagtgtaaatcatttccatcagtttctcgtccggctgaatatctttctctaccacgtgcttcatcatatccgaaagaatatccagctccgactcgacaacagccaagtagatatcttccttgctcttaaaataggtatagagcgttctcctacctttcttcgaagcgagggcaatatcattcatcgtggtattctcaacgcccatctttgcaaacagctgacgggcaacgtccactaatttagcttttgtcttcgatacggtcatagattaattgcacattgctttattatttgagcaaaagtaagacatttccgcatatcttacaagaaaacattcattttattaatgaacagccctaaaaaggaagaaaaaaagtaggcttattatcgttctatttatcaacatattactcattaaaatccacttaacctcaaaaatatcatgcattttatttgcatattaaataaaaagccgtacctttgcacccacaaaacaataacatcgcggagtggagcagttggtagctcgttgggctcataacccaaaggtcattcgttcgagtcggatctccgcaactacaatgaggataaaaggtttaaaggccgtttatcctcattttttttaattcccatcaaggacagaaaaaaatgtttgcgcaaataatgtttgtgcaaattgcttccacacttccacctcctctccacatccctttattcatcggcattacagatgcggtggaagcaactcaaaagtgtggaagcaaaatttgcttccacaccgtttcacaaacagaaatactgacaccacaagaagataacatgtagtaacacaagttattaatttcttgcatcacatcttatttatatcgtacctgacgaaatcaatatcctgcaaatacggtattaattccatctcctctcccttcaaatgtaatcagaacgaatgcgtacagccacacaaagccaagacttcaatgctgttttcctctgtgctttattcagagaatgagggtatttattacgctgaacataaggaatcaacagcatgcaacggccatgatgcaatcgcctaacggccatcaacaactcgcttaacagccgtcagcagatcgccgcacgaccgttagacgctgataaggcaatgagtaaaagggagcactcccctatacacaagcaaacaaagccctatatacaacggattgaaagtagcggtcttccttagaatatcctgatgaaaagcaatcccagcccgatggcaacgccagtcgaaacaagtccgggaagcatgaacgagtggttcagcacatacttgccgatacgggtagttccggtacggtcgaaattaatggctgctactacggtgggatagttgggaataaagaagtaaccgtttacggccgggaacagagcaaccagtatcataggcgaaatgcccaaagcgatgcccaaaggcatcagtgcgcgcacagtggcggcctggctataaagcagaatcgacatggcaaacaaggctatcccgaacagccacggcatttgcctcaccactccctcgatggactgggtcaactgaagcatgtttccctgaagaaaagtatctcccatccaggcaatgccgaatatggcaatcaccgcctgcatgcctgccgggaagacggagccttgcgttgccttcatgccgtcggtgcgagtcagcagcaagatgagggcggcggcagagagcatcacgatttcgataatggcggacatgccgagtctcaccgtctcgccgtctatcacgaaggcaggacgcaaactgtcgaacgaaccaaagaacacaataaaagcagtggcaaggataaagataagcacggacaagacggcatgccgtttattgtgtatatcctttatctccaccttcttgacatcaagatagccttcggtcaacctctttctgtactccgggtcgtctgccagctccttgcccaccttcatggagaacaaggcgcccacaagtaccccgataatggtagcaggaatcgttattttcagaatatcgaacaaggtgacatcaaatcccgccagcaacccaagcagtgcgacggtggcagccgaaatgggacttgccgtaatagcctgctgcgaagcaatcaccgcaatgcccagtggcctctcgggacgaatcttggtctccgtggcaacctcggcaatcacgggaagcaccgaatatgccacatgtcccgtaccggcaacaaaagtaaacaaataggtcacaatagggctcaagatggtgacctgcgaaggattcttccgcaacaaccgttctgccagctttaccatataatccagtccgccagccgcctgcatgcaggatgcggcggaaatgacggcggctatcatcaacataacgtcaatgggaggtgatgtaggctgcaatccgaaaccaaacgtcagaattgccagacctatccctcccattacacccagtccaatgccgcccaagcgggcgcctataatgatagctaccaatacgaatgccaattgcaagaccatatactctacactttttgattcatgtgcaaagataagtcatttcgtattatggctactcacctacttctattttaactacttgttttaactccacactcaaagaggcatcatcctttaacggtgtccagaacacccggcggcattcattcttctgtaaaagacaacgatgatagcggctgccggacagatgctccgtatcgatatggaaggaaccagtattgacatcccaatcggctatctcgtccagattcaaataaaggttgcgcactgtgccgctgttgaaatgcaagctctgcgcctgcgccgcaagcgcagtgacatggcaatcttccagccgggcaaggtctcgcgtgcggaaagagagcgtatcgcaacggagtccgtagaaattggtttccatatcctccacatctaccacaaccgcttgtacctccgcaggcaaccgcaattccatcccttccgaacgaacccttatccaaatgtcattctgaagatgctgtaccagcttatcctccggaaagtcaaaggtgacgagcagggtatcgccaacggaagtcatcgacataaaagtctccatatcccctgcataggagaaactgccctgctgcaaagagtctccggcagttacctccaacggcacttccccgaacgagaatatacgctccgcctccacaataccttcttttttctgtttccacaccaccggaggctgtgtcagcttcaacaccctgcacgagggcagctgcaccgttttccgttctccgccgatttccataaaattatctttctgagtgacattgcggtccaccacatagaacatgagtccgcataccattgccacaccggtaaccagcattcctatcattatataagtcgttcgtttcataactgtcttcttttatttttgtttcttgataaactcctgatacatcccggacaactcctcggcagagatgcccagcgtgaaaatctgcttgaagaaataatccacttcctccttcagaaaatactctttcctcaacgagagaatcagcttgcgtgcacctaccgacacaaaatagccgataccccgcttgttataaatcactccttgcgtctgcaagtagtcgtacgaacgcatcaccgtattggcgttgacctctaccacagccgcatattcccgtaccgaaggaatacgttcttcctcctgatattgcccgagaagtacctcgtcgcaaatgcggtctgctatttgcaggtagatggccttactttccttaaagttcatagttaccagcgattaatgatttcggactccttgaaacggaaataggcaagcacccagttgaaaagggagaaaaacaaagttataaaaatcagccagtcactcgatgcttccctgttgatataaggctcggtcataaaaaaattattgggtagaatggtttccagacacaatacagctatcaagatatatgaaacgaagatgcagacaccggccgcaaaagtcttgataagtgcattttggggccagatcgtactgcccagcaggaagaaagactgtaggaaaaagtagcagctcaggaatatccccaccacagccggtccgcttcctatcgtctcatagaaacggttcgtgttacagcagaattcccacaacggaaaggagtgaacgacatgcagctccgggtaggccagaagatagaagatgactcttgtcaagtccgccagcttgaaagctatcagaaagaccaagataaagccgcaggtagccaccagccagcgggcaaagaatttctcgaacatggtggcaggtgtcatgagcacaacggtacgactcgtcttgcttttcatcctttccatggcaaacgaggcgctaatgcatccccaaatgataagtccccaaagaaagaatctggactcaaactcccagatagggtccatgcccacagctcccgcttccagattgtgatactgatagtatccattccagacaaagactatggccaacattccgtagaccatcaccgagcggagtatataggtcttccaattctccaccatctctttgcggcatacgttcacaaagcgatgcaaactaaaaaaggtatcgcgtatcattattcatttgttttagtgtgaaacatttccgctatcttcccaggctctgcaagcacggcgccaaacagcagttcaagattaatctccgattcctcaccttccgtattgggcagcatcaagaaattgccttgtacggagggaagcgtgtacaaggcagtcgcagccaactcccggtcgtcactctccaagaagaacagtttactgcaaacgctggcagtggattcgtccagcaatacgcggctgttgtccataatcagaacatggtccagcactttgtcaatgtcacgcacctgatgggtggagatgacaatcgtcttgtcgtccgacatacccgaagccagaaatttgcggaactggctctttcccggaatatccagtccattggtaggctcatccatcagcagcagggaagtattggtggccagcgcaaagctcatgaagattttctttttctgccccatggacaaggctcccaaatcagcatccatatccatctcgaagaaatgcaggtacttcaccatgtcttccttgctgaaacggggatagaacttactgttcagttcaatatagctgaccagggaaataggaggcagctcgaactcctcgggtaccagaaacatgtcctgcaacgtgacgggcagccgacggcgcatgtcggtatcatgatacatcactctcccacgtttgggagccaacaaaccgctcatcagatagagcagcgtagacttgccgactccgttcttacccaacagaccgtaaacccggccggattccagcgaaagtgaaaaatcactcaggacttctttccgccccttgcgataactaaatgaaatgttttctacttgtaacatacgcttggatgaattaaagatttcactatttacgtgcattagtacaatagtacactacaaacataggcattttttttagaataacaagagatttgagaaaaaagaaaatacgtacgaaggttcaaaaaaaggaggagctaagaatcactctccactcctcccgacacgacaaacaactaaaattattgctatttgatgccgtccaatgccttgtttgctgtggcattggtggggtcgatagccagaattttattccagtactctttcgaagtagcatagtcactcttcaacagatagtagtagcccagataactgtaacactctatcaatgcagagttgtacctcggttcgtttttggcaagcagtacctccaccaccttctcgtaataaggtttcgccaatccctctgtagtttcggggtccatggcagagtgtgtgcgagcgcgccacatatctcccaaataactgtcgggagcttgttcggcaacaagtgcgaacacagagtcggcagcctgcaatgccgccatgcggtcggcaggctgaacggcgagagtgtcgtccgaggacgtaccctctccgtagtacagacgccctaactggaataagttttcggacatctttttatcttgtgccagcgagtcatagtactttttataagcagcaatggcttgggtatagtcgtttttcagttcataagcatcggcaatctcacgccacaagtccacctggctctcatccttctccaatgccttgccatattcctcaatagcctggtcatatttcttcagagcactcaacagagcaccgtgatagcggtaatccaagtatgaataatcggcattatccgaagcattgaagaaagcatcggcagccttctctgcctcgtcataacgcttgaggtcgacattgttgtacatcacaagccggttgaatgcggcatggcgggcattcttctgcaaacctttctgcgccaccgccaaggatttctcgaagtcgtggttcaggaatagtgcaaaagcatatttaaggatgtcatcttccgtagccacgggagtatcgatgaacttggcataggtgtcggcagccttgccaaaacggttggtggcgtaatacacttccgccagctccttgtctgcttccaggcaatccggagctatggccttcagctggttcagcttctctatggcctgcgaaggactggcagacttgtatgcctgcgcatatttcagatacgcatccttataattcgaatcaaaatagatggcttgctcataaagctggcatgcctttccgatatctttccgggcaaaagcgatgtcaccctcgagtacagaaactgccggagccttgttgtcggcctttcttgccatctccagataggtttccgcctctttcagctgtcctacatccagataggcacgggccacggaagtcacaagctccacatttttcttgttcttgcccttcagcagttctccggctgcatcggaagcctgctccggattcgtctttatcagactttttactttatccacccccgcctgccattcgggcaccggcgtttgtgcggcgagcgtacctgcaaacagcatcgctcccaaacaaaatacaaatctacgtttcatgttagcattcattttagttattcatccttgacgttcaccacgcgcaccggttgggtggcggggaccaatcccgacttcaatataatccgctgtccccggtcggaagcgaggaaagaggcaaatccccacggaagtgcgctccgcggatcattcaacaaggcatagatgctgcgtgccaacggataatcaccgtaatacaaatacgcctgatagggtttgtaactgttgtccggcatggccttgtcagcagcactgacggacatcagccgcacctctttactgaaagagagccccgtactgtcattccggtcgctcagccagttcacgccgataataccgatggcatcaggcgtgcgggccacgtagtcaatcacctccctattggttttcaacgctttcaactgactggaaagcggtacacccttacagatggaatcgacagcaaaacgtacggtactggagttcttgttgtcaaacacaagactgatatcccccagacgggaagccggatagatatctttccactgcttcgcatcacccgtcaggatgcggcggatgtccttcacactaatcaatgaatccggattgccaagatgggttatcaatgccagcccgtccgtagcaatctttatctcctgcggaaaaaacttccggctattgaaggaattcatctcttcgggagtcagtctgcgactggttattgccaaccgcagactgtccttgagcaagaggttgacggcatcgacttccgtcacataacggggcacaattcctgccaaggggaacagtccttcgaacacgtcaatttcttcctgcacaataggctggaaactttcgtccgcagcaattgcaatcacaccggaggtatacgtatccgtttgtccgtccttgggcttgctttggcaggcagacagcagagtcagcagcaccagcaagcctgaaagctgaagttgtttcaccgttttcataacacacacacttattgtaatctaaacatcaccggtatcgtatatttcaccgatacggccttaccattctgcttgccgggaatccatttgggcatggacataatcacacggacagcttctttatccagataggggtctacacctctcagcactttcacatcacgcaccttgccgtcggcacctaccacaaactggcaggttacacgcccttgcgtaccgttttcctgggcaatggtcggatacttcatattcttgctgatgaactgcatcatctcggcctgaccaccggggaactggggcatctgctctaccatatcgaaaaccttttcaggttccggttcggcctgcgtcaccacttgtttcaagtcggcgatgtccttgccgtgttcctcgtcattacctttcacgtcggcaatggagatggcaactttcgtttccgtcagttctgtctggctttttatttcatcctcgtccctcacttcctcatcctttttgatgacgggagcggtaaacttaatggagcttttcaatgcaggcggcggtggggccacgggctctatccgcttcatctcttcctgcttcacttccggttcttccagctgcgaaagggtagtcacttcggtcatcacctctttctgtttgggggtagccatctttatcagcgtagggatactgaaacctatcaatgcaattacaattaccagtatcacggcaatgttgtgccgtctgggagaggtctcacgcatcttataggctccatatgctttgttcttaccactgaacacgaggtcacaccatgcttgggagcttaaatctactttagccatattctttcctttctttgggtgttacacatcattcagcaatgttctgggacaattcgcccttgctttcgtagttcttcatcaagaactcgtcggcttcggcaatatccgttatcacatacttacctatattacatatctgcatttcatcgagagcatcaatcagattcttgtacgaagacttatcggtagccttgatgatgactgtcggcgtatcctttccgctttttatctcggaaagctgtttccggtagtcatcctctgatatcttaagatccagtttctgctgcttcagtctgttcacctcgttcacagcaactctattacgttgcagaagcattgcccgcagaccatccgcctgataggtagtttccttcagtgaagtatagtccttgtagttaggttccccttcgtaataatacaacttgttgtcatcccccagcaacagcgtgatggcttgggaagccttgactttggtctgctgctcctcggtgatggtcttgtcattgctcggcatgcttatctccatggtctgaggtttgctcagtgaggtacaaagcataaagaaggtaatcagcaacatgttcatgtccaccataggtgtaaagtccaccctgacagtcattttcttctgcttgctttttccacctttcttgttgccgctttcttgtatttcagccataatgtttcctttcttgttctacttgtaactcgtagcttgtcactcctcacttgtggtctttagagaagtaatcaggttgtatcggttctctctgaggtcctgaagtgagttcatcacattttttattacggaataaggagtattggcatctgccttgatggcaatgcgcaaatcactgttcactgcacgggcgttgcgcacccaggccttgaactgattgtcaatactgtctgtcggtatcccctcattcttcaatacagcatcttgctggtcttgcggcaagtcgaggtatttcttcatactcttcatcggcacaccaaaggtagacgccagcatgaattttttagtttcctccggagtgaaagtcactccatactcctgccccatagcttccagcacttcgcgcaagtcggactgcttgtccagactcataaatacttttccgctcggatcgaccaatatctggagtacatttgtctccgggatcttaatctcggagacagaggcgggagtcgttacttgtaccggttctttcttcacgaacgtagaagtcagcatgaagaaggtcagcaacagtacagttacgtcactcatcgccgtcatatcgatgaacgtacttttcttttttattttcgctctgcccataatcgtttcattgaaaattaaaattgagaattcattcgttgaatagataatagaagcctacgtcacagcgcagctccaactatcagcagtcaactatttatgggtagctgcaaaagtctgcacgatggagaaaccaatctcatcgaggctgtaagtcaacttgtcaatcttgtttgtataatagttgtaggagataacggccaatgcaccggtcaagataccgaaggctgtattaatcaaagcctcggaaataccttgcgacagagccatggagtcggctgaacctccggctgcgagggcggcaaatgaacggatcataccaataaccgtaccgagcaatcccatcaatgtacctaaagtcgtgatggtaccaataataggaagattctgctccatcatcggcagttccagcgcagtggcttcttccaattccttctggatggcaagcagtttctggtctttggacaactctgcgtcattctccatctcggcatacttcttcaaagtggcatttaccacattggctacagaaccacgttgtgaatcgcagatttgttgtgccttcttcatatcaccttcagccaaggctgctttgatgttagctacgaatttcaccaatgcccccttaccaaaggcagcgccaatggcaatataacgttcaatactcagtgcgatgacagtcagcaaaagcgtttgaattacaggaacaatgaatccacctttatagatggtaccgaggaagttacccggcaacggatggttgttcgggtcgttgttcatgaagttggagggatttcccaacacaaagtgaaaaataagcacggcgatgataaaacagattacgattacccaaccggcggatctgatgcctttaaaagaggctgcttttttttgagtagtttccatgatgaaaagtttaattgttggtatttaaatagagttttgaaaataaagcatagggatacgacttcccgcttacgaaccgatagggcgtaatcatccttgcaaccttagctagcatatatgtacactaaaggtcacctgctttcagtctcttcaagacaagaagggaaaaaagggggaaatcaataagaagaaaagttggctaaatcaaaatccgccgaagcgtatagatatagtaatcactgcccgtcaatgcatagtacggggctttatctgagtagtataatttagaacgaccttgaacgagtagattctcgtggttggataatatcagaagaatgtttctgaggaaaagattgtcttcaatcaccctgcgcaaacgctgttgatgagaagagtaagtttcggaaactggtttgtttcccagttcgacatccgtagtccatgcaaacttggtattcgtgaacaatgaattcttcttgtcaatactattgtcggaagtagaagaacatgaagataaagaagcggaaacttcagcagttccagccattctgtcatccatctgcaccaggtcaatggctttaccgctaatgctgcaagtcaacatcagtagcatgcatatccagaatgtctttacagttgttttcatgtcgtctaatgattctacaataaataacagatgtctctcttatttgttttacaactatattactttcttttgtaaaaagattaaattgttcactgattaaaggatttactataccttttaatacactgtaaaggtacgaagaatatatgaaatacgaaagtgaaaatagaatataaaacactgattttaagcgtttttaatcattatttagcaccttaattcgggaattaatctgatgaacatgcgatgaataattatatttattcttgctgcgttggcctatatcaataaggaggtggttacttttgtggaagcagatttcatctataccgttatctgttccgttctagttttctgtttcttcaattttcgtaagaaagccaaatgctttgcgggtgatgtgggggcggtgagcattgccttcatccttcttttcctgataggcaggctcatcattgaaacggaagatttcagctggatagtccttttatccgtttatggtgtggatagtgtactgactatcattcaccgcctgatgcttcatgagaatatcgggctaccgcatcgcaagcatctgtatcagattatggcgaatgagctgaagattcctcatgtaatggtttcttctatttacatggcggtgcaggcaatcataatcgtaggatatataatgtgtttaggttacggttattggtatttgacaggtataattcttttgctttgtttttcttatacctgctttatgaagaagtatttcggattgcaccagtctacgtgagtaatactgaaatgatgattagtaaaataatgaaaggcgatggagactaaaatctccatcgcctttcgtcttatttttgaaatataaatcgtacctttgtcatataccaatcaggttataataataacatggaacagatgcgtaaactgccgattggcatacagacttttgaggaaatacgtagggatggttatctctatgtagataagacggctatggtttatcaaattgcaaatgtaggtaaaccttatttcttgagccgtccccgtcgttttggcaagagtctgcttctttctacctttgaagcctactttcaaggacgcaaggatctgtttcaaggtttggccatcgaacagctggaaaaggaatgggaagaatacccggttttgcacttggatttgaatgcccggaaatatgaaactgctgctgacctgacggctatgcttaatcagtatctggagaaatgggagctgctctatggtcaggagaagaaagaccgtaatccggaagagcgttttgcttacgtgatagagcgggcatgcatgcagacaggaaagcaggttgttgtgctgattgatgagtatgacaagccattgcttcaagcggtcttggatgagaacttgctggatgagtatcggaaaacattgaaagcattctacggtgtcttgaagagcgctgaccgttatcttcgttttgttttcctgaccggagtgaccaagtttgcgcaagtaagtgtgttcagtgacttgaaccagctgaatgatatcagcatgaagtctccttacgctgctttgtgtggtattaccaaagaggagttggtgaaaacctttctgccggaacttgagagactggctaaacgaagagggatatccttacaagaagtgattgatttgatggaacgtcaatatgatggttatcattttcatccggaaggtgtaggaatgttcaatccgttcagtgtattgaatgcttttgatgcagaagagatgggatattattggtttcagaccggcacacctacttacttggttgacttgctgaagcagagtgattacgatatacgtctattgatagatggagtggaagtgctggcttccgctttctctgaatatcgtgcggaaacaaataatcctcttccgatgatttatcaaagtggttatttgaccataaaagggtatgatgatgatgtgaagctatacactttaggctttccaaatgatgaggttcgttacggctttctgaattttctggttcctttttatactaaagttactgatgatgagactggtttccacatcgctaaattcatgcgtgaattgaagagtggggatgtggaggcgtttatggagcgtcttaagatattcttctccggtattccgtacgagttgagtgatgatacggaacgtcattatcaggttatttttcatgtagtatttactttgctgggacagttcatccggtccgaggttcgcagcagccgcggccgtgcggacgcggtagttcatacccctaccgctatttatgtttttgagttcaaactggacggtacagccgacgcagctctgaagcaaatagatgagaaggggtatctgattccttataccttggatggcaggaaattagtgaaagtaggtgtgaacttcagtaaagaaacacggaatattgatgaatatattgtcgtagaggaataggaacgaacaatcatatatatggaaaaggcgatggagaattaattctccatcgccttttccatattataaaatttcaccttatttcttcattctcagcacccgtattcccgtccacttattattgtctttcagcatttgggacaaggggactttggaaacaaccactttcttgtcggtagaagaagcgtgtaccaacaggagtttgccatctgcatagaaagcgattcccatgtgggctacgtccagccccggagtgttggtggtgatggctatgatatcgccgtctttaatccacgggagaccatcggcgggaagtttggctttgggaagatagtgaatttccttgctggacaaggattgttcaatcttcttcattttggctatgttctccggagaatttgccagctgcttgtagagttgggggtgggaagacatgtaggagatggataactgttcggtgtcgggactcatggcgcccgttacatcctgaaggaagccgttgcgtacgccattgtttatccagtcggcaatataatgcaggcgggaagtgtacccgtcgattttaccgtcacggtaacggattttttgcaggttatcggcgaaagcgctttccgagatgtctccgtcggccaatttgggggtgagtgtctctgccagcacatattccaccagcgtggtgcagtctacctcatcgcagttgatgacgagttcttcgggaccatctgcttccagcgtatgggctacgtatggcacatccagatactttattccattgctcaacatatctttccctccctgggcagaaacggaagttaccatggctgcggcgcagagggcgctgaacataaatttagtcattgttttcatttttctctcttttgattattattgttcttaaacgtaaaaaggatgcagcaaatttactacatcctttttataaaagcttaatccggagggattaaattcaatattgctggattaaatatttataatcctcctttttatcgaacggaacaagggagaaaccgtattcaatggcattctctttgcccggacgaatcagatagggttcatgggcggttgcgccccaactgtcgtctccaccgacacccatcatgcggtagtcaatgaacaaatcaaccatcttttccggcagaggatcggtgaggtggcgatgatgggtcttttcggtacgcggagcaccgttatcaatcgtgtcgccgctatccatgctctccaggggatagttggaggcgttcagttcgaaggtgcggtcggcgatgagtagcaagccacgttgcgtcttatcggtaagggcgcaccaatagatgtctgtgcgatggttgttctcttgcgggcggacgtaaggctcgtacatatccttgagcgggatagtatactctccaataaactgggaggtacggcggtctcggtagttttccttcggaccgcgaccgtagtaggtcaagtctgtaaagatcttttgcaactgcatccgcaggcctacacgcggtatcatcgaagcctggtctccttcggccacgaagcggttgtctaccttgataactccgttggcatatatcttataggtgatgtcccaacgggcatctgtctgcggaaaatgataggtcacctttactgtcgtggcattgctgcccggagtcacttggaaactttcggcttttggttcttgatagcttgcctctttccaggctttgaggcggacggggaggttggctccataatcattgtccgtcggtgcacgccagaagaatgggcggggaccttgaccgttcagtatgtactcgtgcttcttgtacaaataggaggtgagtaggccgctttgcttgtcgaaggtggctttgaagtcgggaccgaagaacgccaccaaatttccttcttccttagaagtggcgggcttctgtgccgtagcctctttcttgtagaaggtatggacgtaggtctgttcgcgtgcaatgaccgtgccggccgggaggaaaggttctgccgtcttgatggctgcatagaactcgatgcgtacatctcccgttgtctgtttctctttgggtatgccgttcagaaagccggtggttactgtcttgcccggtgcagcatggatattttcaatcttgccacggtagacttcctttccatggtcgcggatgatgtagtagaagtcgtacttgtcgagattggtgaaagagaaatcattgcggattttcacggtggaagtttgcttgtcgaagtcgaggaacttgatgttctggtagaccttccccatctcttccgtctgcggtttgacactgcggtcggggtataccacgccgttgatgcagaaattgccgtcggagggagtgccgttctcgccataatcgccgccataggtccagtatttacggccgtcgtctgtcttggcggcaaagccttggtctacccagtcccagatacagccgccctggaggatgggatatttttcgatgatatcccagtagtcctggaagttgccgagactgttgcccatggcatgggcatactcgcaaagaatgaggggacgcgtcatctccttgttccgggcatacttctccagataggaagggggagcatacatcgggcagtagatgtccgtattccattccaacagtgcacgttcatactggatgggacggctgtcgagtgtcttcaaggtgttgtaagtgacgtagaaattcaatccgttcccggcttcgttgcccagcgaccagatgatgactgacggatggttcttgtcccgctcgtacatattcatggtgcggtcgagatgggcattcatgaagagcggattgtttcccagcgtaccgcctacccgcaagtcgtaacccatgccgtgactttcgatattggcttcgtcgatgacgtagataccatattcatcgcagagttcgtagaaacgttcctgctggggatagtggcaagtgcgtacggtattgacattgtatctcttccaaagctcgaaatctttcttcatcagttcttcggagacatagtgaccggtattctcgttgtgttcgtgatagttcacgcctttcacgaggataggttgtccgtttaccaacagttgcttgtccttgatttccactgtacggaaacctactttgcagcttgtcgcttcaatcacatctccgttcgggcgcttcaagctgacgacgagggtatagaggttgggcgtttcggctgtccattgcaggggttcctggatggtcttcttggtgaattccacttccgtttggtcaccgctgacctgagtagaggactgggctatctgctggtcgttcttgtccagcaggcggtaaccaacgacaaatggggcgttttgtccgctttcattggtaaactgcacctttaccttgaggataccgttccggtagttgtcgtccagaggagcttccaccttgaagtctgtgagatggatttgaggctgggcatataagtaaatgtcccgttcgataccactgatgcgccagaagtcctggcattccagatagttggcatcggaaaagcggtgtatctgaatggcaatgacattcttccctttcttggcaatggcgctgacgttgaaacgcgccggagtctttgcatctttactcatgcctacaaacttgccgttaaggtagtagaaggctgccccgcgtacaccgtcggcactcaggaaaatctccttatcgtcccagtctcccggaagggtgaactcgcggcgataggtgccggtgggattccattccttgggaacgtacggagggttgggcttgtcccaataaggaggatagcccgaagaacagaactcatagggatggttcacgtagatgggcgtgccgaatccttgcaactcccagtttccgggtacattgatgtccggccagcggctggcgtccacacggtccatcatgaagtccgtggggcggtcggcgaaggtttccacataatggaatttccatttcccgttaagggacaagcggaaggttccgttcttgcggtcattgatgacggcatcggcctccgtgacgtaggaggtgaacgtgctgcgggcaggctcccggttgatgcttgtcagcttggggttggtaatctcttcgtagcgattgttctcctgagcagtcagggcaaagggaaaagctgcgaggcaagtgagtaaaaaatactttttattcataattgcttttatttctttgtggtaggttcagagaccgggaatacgagcccttcacgcaaccacttctccagttcttccgtccattgacgcttgtaggtgaagttgtcccggaatccccagccatgtccgccggtagggtaggcatgcaggctggcaggcactttgtggtcacgcaaggcgaggaaatagccaatgccgttgatgggtggcactgcgtcgtcgtccgaagaaagcatgataaaagcctgcggagtgcgtggggacacttgtctttcgagggagtatttttgttccagctcctgagatggattttctccgataaggttctggcgggaacctccatgggtaacgcctttctgcatggaaatcaccggatagaacaagatctggaagtcgggacgggttttgtcactgctgtatagtgtggcaagcgaagctgccagatggccgccggcagaagcgcccatgatgcctacgcgctgaggattgacaccccattcagcggcatgtttgcgtaccatgcggatggcttgttcggcatcggaaaggggcacttcatggtgcccgttgggcatacggtatttcagtactgcataggtgatgccttgtgtgttgaaccagggagccatgtcgtgtccctcgtgcttcatggccagccctccgtagccacctcccggacacatgatgatggccatgccgttggggtgggaggcaggatacaccgtaagggtaggggtggtgacatcggacacccattcgttgttatggttctgtccggaattggtcagttcgttgttattgggggcaccgttgggccataggggcagctcaacgggcttttgtgcagataacatggtcgttgcaaatagaaaagataaaagtagaatctttttcatgttcttggtatttaaaggttatttggttttcatggaagctttgatgaggtagaatatcagaatggcataagcacccagcgccagcacttcagaccaagtgttttgcaaccatgcatcgttcacgaggttgattcctccgaagcgcatggcggcgcttaccacgcccatcaatgcaccgccggcaatgaaaccggaggcaagcagtgtgcctttttccccgcgttcggcattgagagcggcatccttgctgcggctggtcacgtaccagttgacggcaccgcctactaccaacgggacattcagttccaatgggatgaacatacccaatgcaaatgccagtgcgggaatcttgcagaagttgaggatgacggccagcactgcaccgatgccgtagagcagccaaggagcacccacaccgttcatcagaggttcgataacggctgccatggcattggcctgcggagcagccagttgtccgctggtgaaaccgtatgtcttgttcaggataatcattacaccacctacggtagcggcagaaacgatggttccgaggaacttccaggtctcctgcttggcaggcgtgctacccagccagtaaccgattttcaagtctgtgatgaagcctcccgccatggacagtgccgtacatacaacaccacccatcaccagtgccgcaaccattcctccgggacctttcaaccctacggctaccatgactacggatgccagaatcaatgtcatcagcgtcattccggatacgggatttgtgcccacaatcgcaatggcattggctgccacggtagtgaacaggaaagcgatacctgctaccagcaggatggctacaatggtatgtgtcaggtcaccttgcatcacatcgaagtagaagaacagaacaaccagcagcaatgtgatgatggagccgatggcgataatcttcatggagatgtcccgttgcgtgcgcttcacgctggcctctacattggatttaccgcccatttccttggcagccagccctacggcgctcttaatgatgccccaggacttgataatgccgatgatacctgccatggctataccaccgataccgatgctcttggcatagtatttgaaaatatcttccggagccatagcgcctacggttgctgtgatttcggggttccattggttcagtacggagtctccccaaatcatggacataccggggatgataatccaccatacggccagcgaaccggcacagatgatggacgcgtatttcagtcccacgatataacccagaccgagcacagcagcacccgtattaaccttgaataccagcttggctttctcggccagcatttcgccgaggccgcatacgcgggtagtgaaattctcgttccaccagccgaaggttgccacgatgaagtcgtatagaccaccgatgatacctgccatgagtaatggttttgcctggctgccgcccttttcaccggagacgagcacttgtgtggtggctgttgcttcggggaagggatacttgccgtgcatgtcgctcacgaaatatttacggaaggggataaggaagagaatacccagcacacctcccagcagagagctgataaagacttgtgcaaaggtaacagtgatttctttcggataggtttcctgaaggatataaagcgccggaagggtgaagatggcacctgccacgatgacgccagaactggcaccgatagactggataatgacgttttcgcccaatgcgttcttgcgtttggcggcacctgatacgccgacggcaatgatggcgatggggatggcggcttcgaatacttgccccacctttagccccagataggcggctgcggccgaaaagagaatggccatcagaataccccatgtcaccgaccaggcatttacttctgaatacttcttgtccgggctcatcagagggttgtacacttctcccggtttcagttcacggaacgcattttccggcaagccggtaataggttcttcttcttgtttcataggttttgtagttttatgtttttctttaatagacttcaaagatagtgcaaaccgaatgctggataaaatgagcaagctcattattattctgctgaggtgcagcctatcttcgcattttaggcaaagaaagcaaaaaaaaaggagatttaaaaaaatctccttaattctgtatggtaaaatgcttatttggcatctttagcggtcatgtccccttcgataaacaatcgcatgatttccgttttggcattggtgcgcagggtgatggatttcttgaagtgtccggggtatcttccggttccattataggttactttcactgttcctgtctttcccggtgctatcggttcttgtgaatattcgggaacggtacatccgcaggaagctacagcttgatggatgacaagcggagcatcgcctacgttcgtaaacttaaaggtgtagctgactaccggactgttttcggagaatgtgccgaagttgtgggtggtctgttcgaatttgatgtctgcctttccttgtgcataggcataaccgatgctcataaccagcatcatcatataaaaaacgactttcttcatgttcttatcttttttatatttcaacggcgcaaaggtaacccattttcattaaaataatgcctatggtgtgcgaaattgtattaaatcgggctcaaaaggcctctgggcgaatgataagcagggaaaaataggggaagcggatggccgctatccgcttgctgtcattgatatacttctcttccggagtgccaacattctcaaaatagtgataccggtattcgggatgcaggcggatgcagcggtgaatctcatcggtgcatctggacagcttcatgatgacaaccgcactgttttcgcttgtcagtctttctatctcttctgtcgtgacgatgccgggtatcaccgtcagccgttcttcctggctggctacatggagcccgcccaatgcgccggcggcaatgaaggcggggataccggggatgtgcttcacggggatgccgtctgcctgcaatttgtcatatacatagtgtatggaagagtagaatccggcatctccttcggcaacgatacagaccttctttccttgttgccggagggtggagctctccatatagacctcgtcgtaggcgctcagggctttttcgcgctgtttgctcatggggagtggaaagcggtgcaccgtgttttccggaatgtcgagttgcaataggatgtcggctgcgcgtgaaactctgtttccatctttggccagtgtctcgggacagaatatacagtcggctgtctgcagggctttcaagccttttacggtaatcagttccggttcgccgggaccgagagatacaaatatgacggggaacatttgcatgaagacattaaaggttaaaaattaaagaacagcaaaacggctacaaaagtggggaaataatcagtagcaaacaagatattcgctatctttgttatttactaaaacaatctgttttttatggattatcaactgaacacccgcttgaatggcaacatagccatgacttccagctaccatgagcgtgcgtcgctgcaacgtgacaagactctgtataaattcatttgggtacagagcggtacgctcactctggaaatagaccatatctccatgcgcttggaaaaggacgaaatcgtgaccttgaccccgttgcatcacctggaggtaaaagaggtggacggtgaatacctgacgtttgtattcaacagcaatttttattgcatctatggacatgacaacgaggtctcttgcaacggattccttttttatggctcttccaaggtgatgagactggcgctttctgccgggcagtcttccaacctgcatgacatagtccgcattttccggcaggaatcggtcattcatgacaatctgcaggaggagatgctgcgcattgtcttgaaacgtttcatcattacctgcacacgcattgcgcgccagcttttcggggtggggcaggagaaggaaaagacgtttgacatcatccgacagtattatgtgctggtggaccggtatttcaaggagaagaagcaggtgcaggattatgccgatattctttgccgttctcccaagacactttccaatctgttctcggcctgcgggttgccttccccgttgcgggtgattcatgagcgcattgaggcggaagccatgagactgctgttgtatacccgcaagagcgccaaagaaatcagctccattctgggctttgaagacttgcccgcgttcagccgttttttcaagaaaatgaccggcgagagtgtctcggactaccggaaaagagtgaaacgggaagaattgccaactgttgcggaataattgccatttcgtacgtggtggaaaacaaggaactttgcaaaaacaaaaatcaagtcatattactgaaaccatttaaaaagtagaacaaagatgaaaacgaaattgcaaaacttgtttatggctgcgttgacgctggccgcttccactcaaaagttgggtgttaatttgattcgtgtagccatcctggttattttcgtatggattggtgggttgaaattctggaattatgaggctgaagggattgtcccttttgtggcgaacagcccgttcatgagcttcttttatacaaagagtgccccggagtacaaggagtataagctgaaagagggcgagttcaatgaggcgaaacatcagtggcacgtggagaacaatacgtatggtttctcccacggtctgggcattctgattatggccatcggcatcctgacatttctggggatattctctccgaaaatcggactggcgggagccgcacttgccattgtcatgacgatgggtaccctctctttcctggtgacaactcctgaggtgtgggtgcccgacttgggaagcggggagcacggctttccgttgctgacgggggcagggcgcttggtcatcaaggatacggccattcttgccggtgccattgtcgtactgtctgacagtgcaaaaagagtattgaaccaattaaggaaatagacgtatgaaaccggaagcacgcaagaagggattgaatataagaggcaacaaactgccggtctttacacatcccagcatgagtgaagcactgaatgacctgatgggcttttaaagattatttaggcacaatatccgtcaatttgcaggaagagcatttgcgtatctccccaaaaatgacgaatattgtgcccgaattctataaaccctgataatcatgacccggatatctgccataggcattgcactgctgtgcgctttatgcgtaacctcttgcagttcaaaatcaaaacagacttctacagcatcctcttcagaaaagagtcatttgccagttgcggcagatacggcggctgccattgtcccgctttatgctaaaggctatacggtgaagtacttgccggaccatgtccgcctagtggatatacacgaccctcagaaagaaaatggcaacacctttcattacgcactggtaccgaaaggcataaaacccgccggtgtaccagatgattatacggtgatagaaacgccggtggagcacgtcatgtgtatgacatctctgcaactttccaacttcatccgtctggatgcctgcgattgtgtggtgggtatcaccagtacgcgccatctcttcaacaaggagatgaacgaccgtttgaagtccggcgagactgtgaagattggtatcgaagggaactttgataatgaagtgataatgagcatgaatccggatgttatctttatctctcctttcaagcggggcgggtatgatgccatgcgggaaataggcatcccactggttccccatttggggtacaaggagatgaccccgttggggcaggccgaatggataaaattcatcggcatgttcattggccgggaagtggaggcgaatgaaaagtttgctgcgatagagaagcgctataacgaattgaaggaactggctgccaatgtgaagaagcgtccggtggtattcagcggcgagatacgggggggcaactggtatgcagtgggaggaaagagctttcttgccgaactgttccgtgatgccggtgcggattatttcttgaaagacgacccccgttcgggaggtgttacgctggactttgaaaccgtatacagccaggcagagagtgccgactactggcgcattgtcaacagctacgacgggacattcacgtatgatgccttgaagtccctcgacccgcgttatgccgacttccgtgcgttccgtgagaagggagtggtatactgcaacatgcgtgagaaacccttctacgaaagtatgcccatgcagcccgaaattgtattggaagacctgatacatgctttccatcccgatttgttgcccgactataaaccgacttactacgaactgctgaaatgataaaaagacccgtacttccgttgatgttgctgacactggcatctatctttctttttttcctgctgaacctgcttttggggtcggttcacattcctctgcgctccgtgtggaatatattgtggggaaatacggatgaatccgttatttggcagaatatcatctggaagtcccgcgtgccccaggcgttgacggcattggtggcgggagcagggctgtcggtcagcggtctgcagatgcagacggtgttccgcaatccgctggcagggccttcggtattgggcatcagttcaggtgccagcctgggtgtggcttgtgtggtgttgctgtccggggcgatgggcggtgtggcgttgagccgtttggggtatatgggcgaggttgccttgtcggttgccgccattatcggtgcgctggctgtgatggcactcattgtctacgtctcccagaaggtgaagggtaacgtgacgctgctgataatcggtgtgatgataggctatgtggcaagtgccgtcatcggcgtattgaaatatttcagtgtggaggaagatatacgtgcatatgtcatttggggattgggtagctttgcccgtgtctcgggcgaccagatggtgctgtttgtctgcatcatggctgtgctgcttccgttgtccttcctgctgataaagacgatgaatctgttgctgctgggcgatggctatgcacgcaatctgggactgaacatcaagcgggcacgtctgctggttatttcatgctccggtgtgctggtggcgattgtaacggcctattgcggtccgataatgtttatcggattggcggttcctcatttgtgtcgtgccatcttccactcttcggaccatcgggtgctgatgcctgccacattgctggtaggcgcttccctggcattggtctgcaatctgatagcccgtatgcccggcttcgagggagctttgccggtaaactcggtgacggcactggtaggtgcgccggtagtggcttctgtactttttagaaaacggaaaggagaattgaatgaataaggaaaccatacatatagagaatctttccatcggttaccccggtaagggggatgtgaaagtggtggcagacggcatttgcgccggaatcaacagtggtgagctgacttgcttgttgggagctaatggagtggggaagtccacgctgctccgtacgttgtccgccttccagtcaaaacttggaggaaacatatttattgaaggaaaagagataggggactataccgacaagcagctttcgcgcgtcatcagtgtggtgctgacagagaagtgcgatatacgcaatatgtccgtcgtagaactgataggtctggggcgcagcccctacaccggtttctggggaactctttcgaaagaggacaagactgtggtggacaaatccatcgccctggtaggcattccccatctggcacaccgcatggtgcatacgctgagtgacggtgaacggcagaaggtgatgatagccaaggcgctcgcccaggaaactcccgtcatctatctggatgaaccgacagctttcctcgattttcccagtaaagtagagatgatgcaactgcttcaccagctcagccggcaaatggacaagacgattttcctttctacccatgacctggaactggccctgcagatagcggacaaaatatggctgatggacaaggcgaacggagtgaccatcggcacgcccgaagacctatcgctaaacggcagcttgagcaatttctttgcccgtaagggtattgcctttgatttggaaacgggactgttcagggtagccaatgaatatacctcccagatacgcttggcgggtcacggacagaagtatgccatggtgcgcaaggcattccagagaaacgggattctggcaaaccggaatgttgaatcggagatctatatcgaaaccggagatttgaagggagacggcagcttcgtgttccatcggccgggtaaggagccggtaacggtgtactccattgaggaattgcttcaaatagttttgtcattccattcactatgatacatcattctacaaaagataattatgtccacttgacgacggctccggtcccccggctgattacgtcattggctgtgccaaccatcatcagcatgctggtgacgtccttctacaacatggcagatacctattttgtgggtaaaataaatacccagtctacggctgccgtaggtatcgtgttttctgtgatgtccattatccaggctgtgggatttttcttcggtcatggttcggggaactacatctcccgtaagttaggggcgcaggaaacggtggatgccgagaagatggcatccaccggcttcttttttgccttgtttgtcggggcggttctggctgtgttgggattgctgttccttacaccgctttcccttgctttggggtcaacgcataccattcttccgtatacggagcgctatttggaaatcattctgctggggactccttttatgaccgcctcattggtgctgaataaccaaatacgttttcaaggtaatgcggcgtatgccatggtggggattgtgagtggagcggtcattaacgtggtgctcgatcctatcctgatttttgtatgcgatatgggcatatccggtgccgcacttgccacggtaatcagccagatatgcagtttcatccttcttttatgtatggggcgcagaggagggaatatacgtatacgttacagaaactttacgcctacactggctttcattaaggaaattatcgggggtggaactccgtcactcacccgccagggactggcaagcgtggcaaccattttgctgaacgtggcggccggtgcgtatggtgacgcagctattgcagggatgtccattgtgacgcgtatctctatgttcatcaatgctttcctgattggtttcggacaaggcttccaaccggtatgcggattcaattatggtgccgggctgtatgctagagtgcgccagggattctggttctgtgtgaaggtaggctttttctttttgttggtttgtgcggtggcaggtatgggatatgccgaggagattgtctctatcttccgcaagggagaccctgctgttgtagctaccggtgcggcagcattgcgctggcagttcatcacttatccgttgggtgcatggattgtggtcagcaacatgatgctgcagacgatccgcaagcccgtacgcgctacgatactttcctctgcccgtcaagggctgttcttcatccccctcatcttcattcttccttatttcttaggactgaaaggggtggaaatgtgccaggcggcgtcggacatgctgaccttcttcctcgccattccattgacctgcggggtgctggcggagatgaagaggaaggaggcggaacaactgcaacagcggtagtcttgagtatcttattcaatgcttacgggactatcagttgccgctttactttatcgaggggagctgcatggtattcgatgcctacggataccagaaccggtaccccagcgtgaagaatgcggcgaagttcttggggaaatatcctccttcttccgaatagtctatcatctggtttatctgctcattgatttttaccagtcccacctgcatctctgtaccgatgatgaatcttctgtattcaaaagtaagtcccagggcaatacctgcatcgaaacggttgttacccattttcccgtctaccatgctgccgaaagtgtctatcttgaactggtatcctccctgcatactactgctgctataatcgtaggtctcgccggaggtcttgcctgccacgcctatggccgcataagggccgacgctcagcgaggcatgataatccctgcccagatggaggcgggcccctatcatgagggggatttgcagatacagttcatgcattttggccttgccgatttggcttatctcgtctttaccgccgatggacacgaactccaatgcggattgcagcaccaaggtcttgttgaggacatattctgcaccgacaccagctttgtaagctatttgggtgtcactgctggagtgtttcccatgaaaatgggaggtaccgattccagcttttgcatgaaaggacagcgggctttgtgccagaccggtcagtacggtcattgccatacagacggtaatgattatcttcttcttcatgagtaaatttttccgttttcggttatgagtaatactgttagttcgccattgggcagcaagggggtacagtgccggtgacagagctcaatcagtgccttgccaaacttttccagcagctcttcgggaatgatgtcccagagttcgcgggccaggttcatctgtccgatggcggcaagcgtttcttcgctgcatcccgtctggcgtgccaggtcttggatgaattccttgttcatggtcactttcttgctgtgggtatccagattgccttcggccagtttcacggcctttcccatcatcacgccgagggtgacgtgcggtacttgctcttcggctgctattttcaaggtttcgccgataaagttgccgtaatgtacgaaagcctgggcagggaggtcgggataatacgccttgatgaaacgttcgctctttgcgccggagctgatgacgatacgagggctccgggtcgcctttgccacttccatggacttccggatggaattgacgaaggcttccgaggagaatggcttcacgatgccggaggtcccgataatggaaatgcctccttcgataccgaggcggggattgaaggtgcgtttggctatctcttctccaccggggatggagatggtaatgagaataggactgggctgtttggcaatatggaggcgttcaagacatagcttgacgttcttctttatcatttcgcgtggggtgtcgttgatggcagagctaccgagctcaagtcccaaaccgggcatggtgacgacacctacgccttcgccgccgcagacgatgatgttgtagtcatcctggggagtgtcttccggcagcgggtcgtctgtgcggaaaggtacggctatattggccacaactttcatcccgttggtgatgtccgggtcgtcgccggcatccttgatgacggtagcgcttgtctcgaacatgccgtcaccgttttccagaaggtcggagtggggaatatggtgctgaggctctacgggaacctggatggtttctccgttgggaagaactaccggaaattccgtaggacgctttttgaagtagatattgaatacatcccaggtggcggctacggcggcagcggcggcacatgttccggtggtcagtccgctgcgcagggggaagaagtcgggtaaatgtttctcgattatgcggcgcaggccatgctcgccgtttacacagataaacttgtcggatgtcttggggcggcagatggcaaagatgcgtatacccagttgccgggcagcttccaccttttcgcagaatccgcccgatatcccgctttctttgaggaggatggcttcgggatgaagctgtttcatcaggacttgctcgtcttctccgggcgtgtagtagtagaggttcttctcggagaaaccttgttcccgggcgagcttgcgcgagctgtcacggtcgaggatgcggaagtaacagcaggcattctgccacaaaggcttcagcttacctatggtctgtacgccggtcagtgcaagtaagatgaaaatcttttctttctgtatcttctcgatggcatcgtcataatccctgcaccaggtgatgtgttcttcatcgcgtttcgggaagatacgctcgaaacggatgacggggatattcgattccacggagacttgttccagagtctcatgcagctgtgtggcaaaggggtgcgcggcgtctatcagcagctttatgtgatgctgtgcacagaatgtttctatttctattgcatccatcgcgccttgcaggcggatgccattatgcagaagtacgtcctgctcatcccctttggtagaatagtagaaagtttttccggcttcttcaagggtttggatggctatgcgtccttcggtggttccgccaaatattaatatcatgtttgaatgtttatgggtgattaatcgttgatttatttccggtacagatgtttgaactcgtgtgcatagagccgtgacagaccttcacggttgccgatggcttcgcctacgacaatcatggttgtcaaggtgaggttattttccttcactattctggcaaggtctttgagttcccccctgaatatttgttcgtctttccatgtcaagtggtagcagacagctacgggggtagtttccggatattcctgcaacagttcttcctgcacctgcttcgcaatgcttgcactgaggaagatgcacatggtactttgtgagcgtgccatgagatgtagcttttcgcgttcgggcatgggcgtacgtccttcgccgcgtgttaggatgatgctttgcactttttccggaatggtgaactgcgacttcaaggcagctgccgccgcctggaaggaggatatgccgggggtgatgtggtagctcataccgtgctggtcaaagtagttcatttgttcctgaatggcaccatagatacaagggtcacccgtatgcaggcgtacgatgaattttcccttgtcatagaacttcttcatcacttcaaattgttcttccaaatccatggaagcggagctgagtacggtagccccggccttggcacagagagtcagctccctgggaacgagactgccggcatacagaatgaggtcggcgcgttccagcatttggcgtccgcgtacggaaaccaggtccgggtcgcccgggccggcacccactatttcgatgtggccctggcgcacagttcttatgtcaagggcggcggccacggtatagttctctcctttcttcttgggcaccagcagccgggagttgtttgcactcagtaaggcggcggcttcgctgacgctgggggtacccatgtgcttcatgacggttttgctgggatggggcacctctatctctgtcagttcttcggctgtatagaagtagaccgggaacttcttttggagcgctttcactaccggttcgtcacttttggctttaatcgtggagatggaggcgatgctttggggcatgatgccgtattccttcagtgtgttcataatctctttctccactttccgcacgggacctgccagccgggcaaggccgatgccgaggtgtacgacacagggcacgtagcatatcataggcatttccgggaagttggggacttggggagatacgcacagaatcagtttgaagcgtgaaggtttaatgtcctgcacccggtagaatacttctacatgaggcggcaggtgcgcctccatccagtccgtgccttcattgcgcaccgtgagcagcagggcggtgggcttgccggaaacgaagaggctgatatgctcgttcatgcatactctttttttctcttcgggcgtcttggcaagttctgccaacaggagggtggagggctcggcgttgatgaccggaaaccacccgaaacgttggggcagggtatcgagtccccatagaccggtgcagtcgctttgcgtggtgactaccggttcggccccgaggatattcgctacctggtgggtcagttcgttggctcctccgatgtgtccggaaagtacggagatggcaaatttaccggtactgtccacgcaaaccacggcagggtcggtatatttgttcttcacgcaaggagcgatggtgcggacacagattcccatggcgccaatgaagacaaaggcatcatagcggttgaagttttccgctgtgaatttgccggcggattctatatgtgtgcatccctcttcgtgcctgagggtgaagatttcggagtcgggaagttcgttgagcagtgattgggctatgctcaaaccggcttcggagattagaataatagctgttttcataatgggtatgtttaagaaagcgtggctttcataatttcaatggggttatattcgttcaaggcgatatgggtggaagggtggagcaccattccgttccgctcgattcctcggcagaacgcctccttgctttctgccgatacggagttgaagacgatgcagccttcggggtgcagcacttgtttcactttctctatcatttcctccagatgtccgccgtgtccaccgatgaagacggcatcggggcgggcaaagggagtgaggtcggtgtgcaggaaatctccggttaccgccgtaatgcccggtgcgccgaagcggcgggagttggtgtccatcagctcttttccttcggggcgtatctcgaaggagatgacggcgagatgaggaaattgcaggcgggcttcgatggagacggaaccggtacagaaaccgatgtcccagaagacgcggcggcggttcagttccaatgcctgcagggtgagcaggcggatgggagccttggttatcatgcgggcgcgtccgtcaagatgtgcaaactcttcatcggggatgccgaagggacggactggaaagtctggggcttcgctaccgtgcagggagtttgtgcggcattgtccgagatggctgtccagcagcaagcagttgggatgttcgaagtcaccggaaaccgcttcccggggtgtcatccggcgtatgcgttccttttcgggattgccgagatgctcgccgatgtatagtgtgtagtgggagtacccgtattccagcatgcgggcggcaatggtgaccggggtatgttcgcggtcggtgaggatgcctattttgggtacatgctctatgagggcacggtcgaactcctgccacgggcgtcctgtcagggagacggtgcgcatgtcgtcatacggcatgacgaggcggtgtgccaatgtctgcaaggaattgaaagcgggatagagcagaatgtctgcctcgggaagcttacgctttatggtattggcaaaaccgaagaataacgggtcgccggacgcgaatacaatgatggagtcgtccgtagccgtctcttcgaagcgggtaaatatttcttcataatgggaaaagacgtggtccagcggtacggtgatggaaatccattcggccccggcaggcagcagaggaccgacaatctccttatgccgtatgccgccggagaagaccttccccttccgtatctgtgccagtgcttccggtggaaagaagggggaacggttgtcatccattcctatgattataaatctgtgtttcattcaatgagtaatcttatgaaaatatcaagtaatgtaagggggcataacaagtaatgttatcggtcgtaacaagtaatgttatggaatgtcttttttcacttacacatccctgcccgggcgcaactgctccgcatcgttgtagcacagcacggagttcaccagcgtggcagctaagttactgcctcccttacgtccttctacgataatcttgggtatttccgtaaagggtttcaccatgtgtttggactcctgcacatgcacaaagcctaccggtgcggcaacaatgcccgccggatgtgccttgcccttacgtatcaggtcgcagagttccataagtgccgtaggtgcattgccgaatacaaagaaagcatcgggatgctcctccacagccaggcggatgcctgcctgggtacgggtgatgcctttctctgcagccatcgtcgccgtgcgcgggtcgccgaggtaacatttcacctctatgcccagccgctgcaaagctcctttgcggataccgctggctgccatcgtgacgtctgtgacaatcgtcttgattccgcctttctcgatgacttgatacaaggaagccacggcatcttcgtccgtatgcagcagatgctccatttcaaaatcggcggtggtatgtatggcatggagtaaagcccatttatggtcgaggggaatatgcttgttcttcagttccttttcgatggtacggaaactacgaatcatgatgtcttgcccgatgcccgtggcttcggtattcgtgtcccggtaatagccgcgcggagtgatgaaggctccgttccattcgtaggactgtgagttgcctatcaatacgactgtaaacatatccacctcttcgggattgaaatctcccagcgtggtgatgtgtaccgcttgttccgggcgtcctgcttggcgtacatatcccacgggtgtttccggtgagcgtccttcctgcagaaagagttctttcaagcggtaaagctgccagtagcgtccttcacttttggggttgtagactgccgtcacgaagtcggcggcagcggctgcggtgatacgtctttcgatacgttcccagggagtcatcaggtctgaaagggagatgacacagaagtcatgtcctacgggagctcccagcagtgaggctgccttttggaaagcgctgatgcccggcagcgagacgatttccacgtcgctgttcctttcccgcttcatctcgtagataagcggcgtcataccatagatgcccgcatccccggagctgatgacgcagaccgtctttccctgctccgccagctcgaaagcctgctcggcacgggcgcgttcacgcttcatgccggtatctatgcatgctgttgaggggtggagataagggattacaaattggaaataatacttatatcccaccactacatctgattcttgcaaagcggaaattacggcgggagtcatatccgattcattgcccggtccgatgccggcaacaattattttggggtgtttcatatccatatgttctattggcatacaaagatagaacttatatttgatgaaaccgaaaaaactctgcgctaatcggcgtaatctgtggtgaaactttattgtctaaacctgcaagtgccggtattcgctcggagtatagcctacgttcttcttgaacacgcggttgaagtgctgcgaatactggtatcccagttcataggcaatctggctgactgtcttcccgcttcctataatcatttctttggccaggtcgatgattttgttctggatatattcctgcgctgtctttccggtttccttcttcaccaaatctccgaaatagttggaggagaggaacactttgtctgcgaagtatttcacggaaggcagtccttcggtctgcggtttgtcgctttggaaatagtcgtctatcagtgcttcgaatttcatcaggatgtccttgttggctgccgagcgggtgatgaactggcgttcgtagaaacgcatgcagtagtccagcagcagctcgatgttgcgcgcaatcagacccttgctgtgcttatcgatggggcgttggatttccatcttaatcttcttcagacagtcgaggaagatttctttctcgtcttcggacaaatgcagtgcctcggtagaggaataggaaaagaaggaatactgctttattccttgtcccagcgaggtgccttttatcaggtcggggtggaacagcaggccggaggcgctgggctgcataccttccagcatgttgacctcggtcacctggcccggggcgaagctggttaccgtgccttcctggtaatcgtaatactgttttccatagcgtatgtctccgcatttggtgtttttgaggaaaagggcgtatacgccatagttcaaggtgaaatgcctgggatatccggtggcttcggacaaatcgactacgctgaccagcggatgcagggtttcgagaccgaacatcttgttgtattggtctacagcattgagcttgattacttcttccataaacgttcctgttagttttgtacaaatgtagagaataatccggaaagttccatattgcaggaggaggaatccgtaatatggttacaaatgtccgtaatctgtgtacattgaaaagagctacaccctttgtccggaatggtgtagccatccggagcaaagggtgtagccttggtatgtaaaaggtgtagcccttttacgcttgctggttatcaatcttttagcatagctttgatgtgttccatatagagctggcggatggctttgttttcgcccagtccctgcatgcgtacattcacttgatagccttgcttttcaagttccgtcttccacacgccggcaatgtcttccttggtatggttgccgcataccaacagcaacggaaccaatgtcacgctcttggggcgtgtctctttcagttgcagcagggttgcgtccagggtaggatatccttcaatggtgctgacgtggaagttcttcagtccatgggctttcatcatgaagtcgagcatggcgtaagtagccgtgctgggtagctggttgccgtgccccacatagacaatgtcttctttcttttccggctgttcggcggtcagtataccgattaccttctcgcagtcttcgacggagtagagcaggggatttcccacttttatctccttgaagaagggacggagcttgtctgcatccctgcggacggaggtcatctcactgccttctatcaaggtggtgctctggacgtagatggtccggtagccttcggcgcgaagtttcagcagtgcatccgtagggctgtctttgtacacaccctccttggcaagtctttttcgtacaatcggcgagatgtatgcttcgcgcactgtaaactgcggaaaggcttcttgtgcctcacgggtcacgacgtcgagcgtcaaggcacgtgtctgagggtccgaactgccataatgggtgatgagcagagccgccttctcctcttgttgtgcggaggagaagaggctgatgccgagtaaatagagagtgatgaaaaaatgtttcataattgttgttgtttctaaatgcgttatggagagattattttagtctgagtgccaggctgattactaccgaacgtcccggagaatacaaggcgaagttcttgttcagcgggcggttgtctttcttgttgaagatattgtctataccgatgcccggttcgatgacaaagttgcggaagccgtcgaaggtatggcgggtattgaggttccagatgccgtagcccggagcattgccgtccgcgtcgcccggatagtagactttgctttgcagacgaccgttcaggttgaggttcaaggtatagtcgctccagttgtgtgtatagtttccggtgatggtggctgtatggcgtatgctgcgctcgatgttttgccattcgcctccttcgttcagaccgcgtccataggcgtaggtatagtttccggtcagggtgaagcccgggaacagattgccgttcaagttcacttcaaagcctttgacggtagctttctcgaagttgaagtagttcttgacacttagtttttttgtggatgaaaggtcaccgatttcggggaactcttcacgcaactggttctgctctgcttccggtaggtcatcgaatttagtggatttggaagttaccatgttctttacatagttcaggtaaccggtgacagaagcactgaaacggttggtacggtattccatgttgatggagtaatagttgctgcgttcggggtcgaggttctcgtcacccaatgagatggtggctcgtgtacccattgttttcttgaacatgtggtagtagagctcgtcaattcccggagcacggaatccggcagcataggtggcacgtatattgaagttgcctatgttgtacatggctgccactttgggggtgaagcgtccgcccgtctgttcgtgatggtcgtagcgtacacccacaacaccggtcagatggttccatagcttcacttcatgctggccgtaggctgatgtcgtatagacacttttgtccaaatcggagtcgggacggcggagtacttcacggcgatagtctacaccgaacaccgtagtgctgttggttgtaaaaccgaagatacctttcaactcggcatcatggaatttctgaagcttggtaagcgcatactgtccgggcaggtatccgctgttttctatcaggtatttatagcgtgatgcgtaattgtttcctgaatagtcaaattggataacgttgcgtttactcagtttgtatttgacgcctgccccccagttgtaaccttcgtaggcagtgttgtacttgcttccgccggtgatatcctcgcgttctaccggacgttcgagtccgcggttgtagtatccgccgttggcatagaaggaaagctgttccgtagcatcataggtaaacttctgcgaaaagttattcgagctgtagcccagggagagcggggcaatcgtttcgatgatgtcttctccgtcttctgtcagatggctgttttgccaaccgtcggagtggtcgtatttataggaagtgtaggaccctatttttccttgggcgatgtccagattcaagccttgggagaattgattctttctcgtatagctgctattgctgctgaaggctaccacatctttaggctcgttggtaatgatattgattacaccgccgatggcatccgaaccataaagggaagaagcggctccgttcagcacctcgatgcgcttgacgcgggtcatgtctatttggttgaggtcgatgttaccggtaatgtctcccgtgaccttgcgtccgtttaccaatatcagcacgtgcttgttggagagtccgttcatcatcagataggaccccatcgcgttcggacggaaggagagcgagggtaccatcatggtcaaggcctgctggaagtcggtgataccggcacgctttatctcgttggcagtgataaccgataccggagacggagtgttcttcagtcgctgatgtgtacccgtacccgttactacaaccgggttcaactcgtgagttttcttggtcatatcgtcgctgtcacctttttctgcttgtgcataggcaccggtggcgatgattcctcccataaggagaactgtgagaagtcttttctttatcatatattgttttattttatataacgctgcaaaggtacataccattatcggagggtgaaatacttaatagttgttatactgcgatggccaaatagctattaataggtactgtattcccttattccggcacatagataatctctccattttcaagctgataggcaactcccactttctttcctcttttaccggaggtctttgggtcttcgctgggagtgtatttcttgatttcctgcccttctttggtaatgatttccatattttcctttccgggattcttcaccatggtgaagtcttctttagaaaacatctccgtcatattgaagcgggagacgagagccaccatcaaggctacggcaaagaccattgctacgtcaaaaagattggctaccgtacccatggggtcggagtccgaatcgctgtgcagtaatctgtttctcttactcttcattgttttcgtatcgttagtccgttattccttttcggccgtttggcggcttatcactttgtacagatattccaagtcgttcatttcgcgggcataccagcgttgtttcacttgcagggtgatgatgccgacagcagcaatgaccagtcctaccactgtagtggcaaaagccacctgcatattgtaggccatggaggagatgtctccttgtgccaaacctaccagtgcgggacccatcgggatgagggtacccatcagtcccaacataggacccagcttgatgaaagtacgcgaacgtcccaactccttctcggcttccacttcataattggcaagcaggtgttcgcagtaggcgtcgtcgtcccggtgtgcggacagtttggacaagctgcggaggagaggggagttacctgccgacgggagttgctgcaccagtccgtctatattctctggggtgatgttctccagtgtttcagcgaattgcttctgtaatttcatccgttgatagaactccccgaagaaacctcccgcaaggagaatggcacgtagaaagaatagcagcagcaggactatgacgggaaccagcagcccgttcgaaatccagaacagtgtgtttgagattgtttccatatatctttttagtttttaattctttaattcgtttcaatagcccgtggcaatgatgctcaatataacaatgaaaatattgacaatgaacaatacttccaagcgcagcggcttgtcaccgatagcatatcgcagcaaacggctaccggcaccgactgcaaggaaagtaacaccggctgctatccatgagagactgccgaaatcaagaccgggaaaagagaaaagcagtagcgccaggacgtagcagattactccgcctatcagtatgccggggtatagcttcagcaagagggtgaccgcttgtttgaaggccgtgttgcgggtacgcatttctgcgaaacagtcgaaacagaaagctatcattacggcagcttccagggtgacacataccgacaagttcaacatctgcgggcgggaagcaaaaaaagatgccaccacggtcttggactgttccgtcatccacggagtcaccagccacgcaaaaaaggcacagcctgcggcaaccgtccacattccccagcggggatagaaccccaccttcaatagaaaattgagggcaatgaatagggctaacagatgaatgacatattccataatactctgtttctatttattctttttccttctcttcaacagtacgaccagtccgatgaaggtgatgacgacaagactgcctgcaatcactccgttcactctgttcttacgtaccgtttgttcggaagccagtttgtgttctttcagtacgacattcttgtcattggttacggatgcttcgtgtacctcctgcatgtttcgggtataggtctgcttctcactattgttcaaccggtcggcaacgaacgattggagcctggtattgtcacaaacgaactctgtgcaggcggcacccttctcgcgtgtgatttgtgcatgcaaggaggcggtggttttcagttgctcatcagatgctttccagtaacctttgcgggcactttccagcatgacggctgtcatggcctggaatgcggcgggattgacacggaggaagtactcgtgaatgcccagcttattctcatcctttatatatattctatataagtcattgaacagttccttgtctatggccgacggacgcataacgtgccagccgaagatgttgcggaagatttcgccgaacatctgcgccgaaccttccccgcctttcatccgctcttgtataaaggtagggttcaagacggtggaacgtgtctctacggcaatggcctctttggcatcctgcatgcggcggttggtccggttgcggtagtctgccatataggcatccggttccttgccggtcacggttttgacggtgagcgagagtccgcccgtaaattcatatacatggtccagagagatggggccccatgtgttactttgacggggctggatgacaacatccgtttcggacagtgccgaggcaaacaaaccttcctggacgtctccccaattttcgtcgtccccataagaggcacccatattgttgagatatccttccgctatttccttttcgctttcccacgaaccgctgtgctcggtataggccatcataccggtactgtatccgctgttgaccggtccgaatacacgcatcacagacatttcacgggcacgtttgggggaagttcccttttctaccagtaatttttcctgcaacaatgtacctgatgccacgtagttggaataggtctcattcccggcttccgatgccagacgtatggcatcggtcagtagtttcaggcgggaaccggcgatgtcgcgcagttgcccggagacttgcaccagcacattgatgcgcggacgtcccagttcttcgctgggcaccagtttcaagtcgaccactctgccttggtcatcgcgtacgggttctactcccaacatccagaatacttgagcgagtgtggctccttccgtattgatgaattcgcctgcccagaaggtatagcttactttccggggatatttgccgtgcttgccgatgtactgttttaaagtcgcttctgccaatcgcttcccatcttcccaagcccttgggttgggagtattctcggcgttgatgctgtacatgttgcgtccggtgggcagaacgttcgggttcagtacggggtcacctcctggagcgggaaatacggtctccccgctgagtgcacgcaccatggcattttgctcgttggcggtggaggccagcaactgttcgcgatagagcagggcggggcgaagctccggtgctacagatgcagtatctttgggtggattctggagtaaggcagtcagtcttttcctggcagcaggcaagtagtggtgggctatataggtaaagtcttgcaactgctttgtggtgattttacctttatcgcggtccttgcgggccgtttcgtatgccagcgggtcggcagcgacggcgagagtggtagtcagcaggtcgcggtcagaataaggctcgttcatggtgtagtacgcacccagtatcttttcgttggctatctcttcggtgaaggcatccagacgttccaactcctcggctgtatagggttcgccggatatggaatccagattgaggtcgcggtgcagccccaggcgcatggcctcttttttgatgttcattcccagagcccggtgtttggcagtcccttcgtccagcactttgtgaatatcttccagcaaggccgaatagcgttggcgcataccgctctccacgtagggcggagtgagatgggtgaccagtacggcatgtgttcggcgtttggcaatgataccctcgcctacgtttccggtggtatagaagtagaagtgggggaggttaccaatcagtacatccgaccagtcggcctgcgactgtgccacattctttccgggagtatattccaggttgccgtgggtgccgaagtgaatcaccgcatctgctttgaaacctttttgcatatacagataaggagccagataactgtggggcggcgccaccggcataccgtgcaccagtttgaactcatcatctcccaatgccgggcggggctgggggaagagcaggatattgccgaattgcaggcaggcaatggcgatactatcttctgttgccagcagattgccgggcgcatctccatatctgtccgtcacttcctgatatttctcgggaaggagtacttcgtgtgcccattgttcgtattgctcggtagacaaccataccgggtgtgctgttttcaaaaactgttcttgcgctcctttggcatacgaacccatgacggcaccgtcacgatgtatccgcttgccgaactcctctacagtggcaggcagtccgccgacgtcgtacccttccgagtgcaggcgtttcaagaagttgtagagtgaaggaatcacttccattccgcttgccagcagagcgtcttttcccggagtcttgaagtagcagatggcaacacgtttttctttgttggacatgtttctcagggacatatatttggtaatatggtccactacagcatctatccgttcattctcggcggtgtacagataatatccctgcttgtttttgttttgggtggcgatgcagaggggcagcatgcctccgtctatctccggcaccactatacgggcagtcagcgtaccgccgctgacgggggtattggggttcagccattcctcgtggggctgaatcagcgggaaaggcatgaataaaggaatgttttcctggtgcagccagttgatgagtgagtcattgcccagccgtcccataggtaggtagactactgcatcgggatggagggtacgtatcatatcggcacgcggttggcctccggcagtgaaagggtagacattgaagcctgcttgtgtcaggcgtgtgatgagggaatctacgtgggcacggtttccttccatcggaaagttgcgtccggaaatcagggcaaggttgcgtccgtcctcatggtagagatttttttctttcagataggcagttacctcttgcggagtactgaagtagcagccgtattcgcggtggtagaacatgttctctagcaatgggatgggaggctcgtaatcttggtgtccccaccggtggggagtggcaatgtggcgcaggtagagtaaggcattccggtagttgtgtttgttgccgttcttgaggtactcccgcaacgtgtgctgttgctcgttggtgatgttatagttgatggagaaagcggagtttcgtaacgtattggtaaagaccggtactccgccggcacccacccgttccacttcggcaacttggctgtcatcgagatacaagcccctgctgtacatcacgatggcgtcatagccggaaaggtccttcacatcttcttttttgatgcagttgacttctatccgggcacagtcattgttcagggcaatgtcggcagcttgtgccagggttgcgttgataataagtatacgtgtaggagccagccagtattgataggccgcaaagctgcagacaatcaatagggctatgctgccgaggaatattccaagtcttttcttattcatacaagtttattctcgttaatagagtttttgtcttttgcaacattttcttcttatataattcacacttaacgccacacccgtgatgcaaacggctgtacctccaagcagcaatacccaaagcacagtcttgcgtagggtggcattggagttcagaccgggcagacgcatgcgatgcagggctgtatagctccagtatttccagcgggaggaagtgtctgtatggcggatgattcccgtttccgggtgaatgtaatagacgctccggtccgggtcgtccaccgtaatcttccacacgggaagctgggggcgtccgcgatacatattgctcatgtcgcgatagtaggtctcgaaatgttcgagccgggagatgcgtatgccggggatatgttgtgaagaatcacgccgggaggcataaatgctttccacgcctttcagaatttcttcttcggagagttgcaacggacgcggcaggctgtcggtggcatcgatgtaatattcgtttttgctgtcttttacgatgtagtagggatgttcgcggaagttgcgccactctatctgcaaagcttggggataggcggctatgatacggcggtagtccagggggtaatcctccggttgtggggcacgggcatggagcgtgcgtgtggcgctgcctttcttcagtgccggtttatgaatccattcgggaatgtctgccaaagacatcatgccgctgaaggtgaaggtcagtacgaagatgccgaaaaatattccgctgacgtagtgccagtgataccacctttttcggtagggagagaatttggagtgacggttgcggtgtgtcttgcgccatacatccacagttacccagatgccggcaataaccatgaggcagcccagagctgtgagccagatgacggttttagtccaaagggcggtgtcctgccgcagccaggtgaagtacacccagtgggggatggctcccagccatgcccagaagcgttcgcttttgttggagaactgcaagacttcgccgttttgcgagccgagatagagttgtgtcccggcatcgtcggcaaagtatattttatagacgggcatttcctttttcagttcagcgaagggaatccattggtccagagagtggagggtgtcgatgcgggtaatgggagaagaacaccacaaagctgctgtccggtgcaggtgctcgctgtccaaagagggtcgtgagatggtggaatcggcaaggaaatgaaacgtgccttttgtggtactaaagctgaactcggggtgtccggcattgaggttcagtatcgtagacctgacctttacgccacggggcaggcgggctgtgacggaggagatgtccggaagtgagtctccggcttgggagagcatttccagcttttgcattttctccttggcgctgacacggggaaagcggtggtacatcatcacgaaggcggagaggaaccacatgagaaataggatacagagcaaagtgcccagtatcctatgaatagagtacatcagtttggtgataacattcattgtcgttcgcgtttttcctgcaaaagtacaagatgattcaagaacactaaatacccactaatgggtatattattcagtgtcttttccggcagcataggccgccttcttcgtcatgatgtccagcatgcggtgcttcagtccgaaacggatatggtcaatgaatatttcttgaatttccggaatttgtcccagtccttccagttgtgcactgacggtgaagccttctttctcgagcatctccttccactctccggcaatgtcgtttttggcatggtctccggcaacaaacatgaaggggatgagggtcacacgtttggctttcccggctttcagttgtgccagcatggtgtcaaaggtaggataaccttcgatggtgcccacatggaaattggccagtccgcctgctttcagcatatagtccatctgactgtagatagcggtactaggggtataggtaccgtgccccacaaggacgaagtgttctttggaaactttcttgccttgtgccggggcgttgtagcggttgcccagaatatctgccaccttctctgcatcttctatagagtagagcaggggagtacctacacgtatttccttgaagaagggcagtgcactttccacatccctgcggagtgattccatttctactccgtcaatgatgttggtgctctgcacgatgaggtgtgtgtaaccttcgctgcgcagtttcagcatggcatccagtggagtcagcttcgtggtgccgcgctctttcaagcggcggataatgatgcgcgacgtataggcttcttggaacttcaactccgggaaggcagcttgtgccttggcgttgatggcatcaatggtgagggcacgggtatcgtcatgcgtagtgccgaagtgcaccatgagcagggcggccttgtcaccgggtttcatacttgcaagcatatcgctgtgctcgtaattgcctcccccgtgcgcatggcaaaggagggaggtgcttagtaaaagtaataaagaaagaatcttgttcatagattatttatcgttttcaatcactctaagcatatcgaaataataaccttcggcaatttctgcgcctttttctactttaccggttgctatgtcatagatgtagatacaaggattggctttttctgtatttacgccgatgtatgccttaccgtctataataacggagcgttgtgcaaatcgtccgccactgtaaggtatttcttgtccgttataactcaagcgttcttgtgttccggtattgatgttgatgatagaataatagtggctgtaactgtcgatggcagtaccggctgcatcattacgtgcatacacgagggctttaccgttacccaggttttggatggtgagcagtttaccgtcggcgttgggatatccctcatagcttgcatcgaagtctgtttcacctttcttgatgcggagcagatggccttgttctatgtcattggcatcagtgaatgcagccaagtagaggttaccgtctgcatcatacatcacgcaactttgcatcagttctccgtaagcgcttcccgccatttctccggcaagggtattgaccttgttactttccactttcatgtccgagggattgataactgctgtcaggaagtttgaggttgcctttccacctctgcctgatttgtctttaccgaagtagaagtaatataatttaccggccttttcgttgtaggtcagaatgccggaagctgtgaatacttttgctccttctggcaaaggaaggtccagtgttccttcggcaaggatacgcatgtcgtcagcattcagcttggtccagataactttgtccgcattaccattggctgccatgataatcagggtatggtcatccagccaggcatgtgtgtagccgcgtactttgaaggtattctgtacaaatgtttgttcttggactattttgatggaattaccggttacctgcaatttagtaaatcggtcgtttgagtttggcacttgataatagtatttccctttgacaatggcttccatggaataagtgttgttttcacttctgaactcaacgccgtcattctttatgtcaatgactcccatatctgccgtaaggctgtttacactttttacaatggtaccgtcaccctggttcataccaccgtgtttgccgatagtcataaaaatatcaaagtgataatcggaaagttccggttgcgggtctggatccggggtggggtctggatcgttgttgtcggaacatgcactgaatgataaggtcatggctacggccataaggataccggataaaagatttagtcgtttcattttaaataaaattagttagttgatgaataatctgaatttggcgaagaatgctcgtccgggcttttgcagtttatagttatcataggccaatttgtcgagtaggttcgagcattccagcgaaatattgtatcgtcctcgtttccatgaataggtgatgtcggcattgcaaatgtgttgtgccgggatgcgtgccttgctttcgcgagagccataggcctcccatgtcaggaaaaaccagtgcacccactgataactgcaactcagccgtaatttgctttcgggcagaaccacattgtggaaaagatagcttgcttctgcacttccgaagagccaggggcggttgggtacccggttgttgtaagttgccgaaggcttcccgtcagtcttgtatctgttctggtcgcgtgcctcttgaaaactgacattggtggcaagctgtaacttgctttgccagtcgtaacgtacttctccttctatgcccttgatatgtacagccggaacattcttatattgcatcataccttctttggtttctacggtggcttggatatagtcgtccacatagcgcaggaaaccgtttgcttcataataaagtgtatggccgggggcaggatgccatgtgccgaagatacccagattgatgttgtcgctgctttcgggtttcaaggctacattggcatatatggtggtaccgtttcccaataattcgcgggcaaggggcagccggacgctgtgctcataggaaattttaatggataaaggttctatggctgtgtagcgtgaaccgataccgtagccccaatactttttggttattgtcccttttacatccttcgacccggtgatgctggataaatccgtttgccggatattcaggtggttgatgtagttctttacaaaaaaggtattgctcattttttcttcgagaagggactgattgtaggagaagcctgtcacatgttttgccagaatatcattggaggcttcaaaatcagtatccgcttcatcatagcggtcattgccgatgcggcttaatagatagtttaggttgagggagtgatggttgttcaaccgatagtccagattggcgcggccaatggtcaggggacgtttgtaatggcgcatcgaacggccccgtcctgtgatttcgttacgtgagcttacgatataatctccgttccagtcatacttacggtaggctgtatctgtggtcaatgaatggtcccaagtgtgcgagagtgcggcattcagctgcatgttcttccaaatgaaattatgcttttgatagcgggctgaaatgttccatgcatcggagcctctttctgccattccatataccttactctgtacagagcctgtctgcaactccttgtctactttggagtaagaggcggaaacaaaaaaagcatctgcccaggacttattggcaaagccgatttccatttgtccgaacagtgaaaaatagtcatcatggaagcgtctacggtcagtcagaatgtatttgcggctgtcttcatcccagacttcgacatctctcatcatataatcgtttttggagtaattgaccccaaaggtaggtttaatgatcagtccggttcgaggctctacaaactgggcattcaagtctgccttgtgggtatggaaggaaccgataccgtaggagacatccagatagttcttcttctcttgcttcgtaatgatattgatggcgcctcccaatgcatctgtacccagactggcaggtactactcctttataaatttcaatccggtcgatgatattgaccggcagatttgccaatgaaacgccgctgccttttgtgtccaatggtattccgtccagaaaataacgtatggaattaccggacattccgttgatggagaggtcgaagtccgagccaactccgccttcctctctcaccttaatgcccgttgtacggttcaccaggtcgttgaggttattcagagagtttactatcggcttgatgtcgagtgcattgacagcaaaggccccttccttcactttctgcgtttgggtctttccgtaaacctcgacagagcttagcgttacggtactttcctgcaatgtaaagttctgttttttatcctgccggatgtcgagggattgtttcacggtttggtagcccaggaaggagacgatgaaggtatgtttacccggagcgacttgcagtgaatacttcccccggtcgtccgtataggtgccggaggtggtgttttccacagcgatggtggcttgggctatcggtgtcccgtgctggtctatgacttttccggataaggtgaccttattttgtgccatactacctgcaggaagcaggcagataaatgtaaatagcagtcctgtgatgaatctcatttcagttccttataagcgttcgtaacttgccctcaaggaaaaatgaacaaagagaaagattcctttatatggataaagaatgcctcgactcaatgttttgttgctttattccccgaaagcactaaaactatgttgtcttggcaggtcttctgacttatccctctttgaatgccttcccatccgccgggcggacagtggcttgtagaatattcaaagattttggaaggacttacagcagcgggtctgttcaggatttgcacctaattccctttttcatcactcatctccaacagaaccgggagaggtgaaaccaaaactgggacaaagataacaaaaactattaggtttgcgaatactcctgataatttttcttatctttgcccgcgaattggttccggatgcatgtttccatcatctggattaaaagggaatcgggtgtaaatcccggacagtcccgctgctgtgaagctccgtttatatcatgaaaaacacccttgccactgatatgcattgaaatatcgggaaggcttcaggattaggagtcagtcagaagacctgccattcattaaaggctgcctttgctcgtgggttaggaagacagtacgaagatattagttgaacatttaaacaagaaatggaatgcctttgttaaaggtatgtccgcattgtggtgtgactatatatatcctttatatattaaagaaaaagtaaaatgattaagaaagtattgattgccaacagaggtgagattgccttgcgcgtcatgcgttcgtgccgggagatgggactgcttacggttgccgtcttttccgatgccgaccgtacttctcatcatgtggcatatgccgatgaggcttatccgataggaccggccgtggcaaaagagagttatctgaatattgaaaaagtgattgccacggcaaagcgatgcggtgccgatgccatccatccgggttacggctttttgtcggagaactcggagtttgcacgccgttgcaaggaggaagggattatctttatcggtcccgccgccgagacgatggaggcgatgggcgacaagatagctgcccgcaagcgaatgattgcggcaggcgtacccgtggttcccggaacggaacaacctttgcagagtgccgaagaagccgtgcgtatctgcaacgagataggctaccccgtgatgctgaaggcgtctatgggtggcggtggtaaaggtatgcgccttatccataacgagagcgaagtggtggaagcctacaacacggcacgctccgagtccatgtcctcctttggagacgacacggtctatctggagaagttcgtggaagaaccgcatcacatcgagttccagatattgggcgacaaccacggcaacgttatccaccttttcgaccgcgaatgctccgtgcaacgccgcaaccagaaggtggtagaagaaagcccgtcacccttccttacgccggaattgcgccgggaaatgggagagaaggcggttgctgcagcaaaggcagtgaactactccggtgcaggtaccatcgagtttctggtagacaagaaccgccgtttctatttcctcgaaatgaatacgcgcctgcaagtggagcaccccatcacggaagaggtggtaggcgtagacctggtgaaagagcaaatccgtattgccaacgacgaggtgttgcacctcaagcaggaggacctgttccagcgcggtcatgccatagagtgccgcatctgtgccgaagatacggaaaacaacttcatgccgtctcccggtgtcatcaagcaactgacggaaccgaacggaatcggtgtgcgcatagacagctatgtgtacgacggctatgagattcccatctactacgaccccatgataggtaagctcattgtatgggcaaccacccgccagtatgccatcgagcgtatgcgccgtgtgctctatgagtacaagattacgggcgtaaagaccaaccttgcctatctgaagcgcatcatgcacgtgcccgactttgtgaagggagagtacaacaccctctttatcgagaagaacgcccgcatgctggtacgcaccaataccaccaacgaagagttggagaacattgccatgatagccgcctatatggactatctggttaatctggaggagaacgtttcggcacagctgtccgatggccgccccatcagccgttggagggaattcggcttgcagaagggagtgcttaggatttaaggaatggaaaattgataatggaaatttaataatggaaatacatataggagaccgtatagcagacattaccctggtgggtaaggaagggaataaggttcagcttaccattgacggaaagccctacgaagtggacattgtgatggcagagaacggaagttgctccatcctgcacaacggaaactcgttcaatgcaggccttgtgcgcggcgagggaggaaagagctatgacatcagcatgctccagcgttccttccacgtagacattgtagacacgcaagccaagtatctgcacatgaagaaaggagccgacgagaagcagggcgacaagattctggcgccgatgccgggcaaggtagtgagcatccccgtcaaggtgggcgaccgactggctgccggagacattgccgtggtgctggaagccatgaagatgcagagtaactataaggtaaatgccgactgcatcgtccgcaacatcctcgtgagcgagggcgaaccggtgaatgccaaccaggtattgattgaattggagttgataaaggaggaataatcccgagtcgcattcagtccgtatattataaatcactaaattgtaaatgcaaatatgaacagagaagaaatatatcgccagtttgaggaactggataaacgtgcctcgctgggtgggggcgtagacaagatagagaaacaacacgcctccggccgcatgactgcccgcgaacgtattgacatgctgctggacaaaggctcgttcaatgagctggacaagttcgtgaaccaccgttgcaccaacttcggcatggagaagaaacagattgccggagacggcatggtgtccggttacggaaagatagacggccgccttgtatttgtctatgcctacgacttcacggcgcacggcggttcgctcagcgagacgaatgccgcaaagattgtgaaggtgcagcagcttgccctgaagaacggcgctcccgtcattgccctcaacgattcgggcggcgcgcgcattcaggaaggtgtgaacagcttggcaggctatgcctccatcttctatcagaacaccattgcgtcgggtgtcatcccgcagatatctgccattctggggccgtgtgccggtggggcatgctactctccggcgcttaccgactttatcttcatggtaaaggagcagagccacatgttcatcaccggtccggacgtggtaaagaccgtgacccacgaggaggtggacaaggaggaactgggcggtgcctatacgcatagcagcaagagcggcgttacccacttcatgtgcaatacggaggaggagacactgatgagcatccgcgagctgctgagtttcctgccgtccaacaatatggaggatgctcccttcactccctgctccgacgatatccatcgccgggtagagacgcttcagaccgtcatccccgaagacccgaacatgccctatgacatcaaggatattatagaaccggtgctggacaaccagtatttcttcgaagtgatgcctcactttgccaagaacgtcgttatcggtttcggtcgtctgaacgggcgttcggtaggtatcgtggcaaaccaacctgcctatttggcgggtgtgctcgatattgatgccagcgacaaggcggcacgttttattcgtttctgcgactgcttcaacatcccgctgataaccttcgaagatgttcccggctttttgcccggaacgatgcaggagcacaacggcatcatccgccacggcgccaagattgtctatgcctatgctgaggctaccgtgcccaagataacgctgattacccgcaaggcatacggcggcgcctacatcgtgatgtccagcaagccgacgggtgccgacgtgaacctggcttatccgcaggcggaaatcgccgtgatgggtgccgagggtgcagtgaacatcctctaccgcaagtcctctgccgaagagaagcaggagattatcaaggagtatgaagacaagttctccaacccttaccgcgccgccgagcgtggcctcatagatgaggtcatcatgccgcgcgatacccgctacaagctggtgcaggcattggagatggcgcacaacaagaatcagagcaatccaccgaaaaagcacggcaacatgcctttataatagtagttgttttttatgtgtgaaatgcgtatccccggagaagtgatttctgtggggatatactttttaaatagagaattaagaattaaacagtaaggttgaaaagtaaaaagtaaaaactaaagatagaaactatggaactattaagaaacctctttgagggttatcccaatctttggggcggaggagtggcacactctgtcctgattctgtccctggtcatcaccttcggtatcatgctgggcaagttgaaggtggcaggcatctcgctgggtgtcacctggattttgtttgtgggcattgtcttcggacatttcgacatgaacctcgacgaacatctgctgcacttcctgaaggagttcggcttgatactgtttgtctattccatcggtctgcaagtgggaccgggattcttctccgctttcaagaagggcggacttacgctgaacatggtagcaatgctttccgtcttcctcagcgtggttatcaccattgtgttgcactttgccaccggaatccccattactacgatggtgggtatcttgtccggagccgtgaccaatacccccggtctgggtgctgcccagcaggcaaacagtgacctcaacggggtggatgctccggaaatcgcactcggatatgccgttgcctatccgctgggtgtggtgggctgcatcctggcgctgctagccttgaagattttcatgcggattaatacccaaaaagaagaggaggatgccgagcacgggctgggtcatctgcaggagctgaccgtgcgtcccatatcggtagagatacgcaatgaggcaatagacggcaagcggatcagagatgtgaaaccattgttgaaccgtgcgtttgtcatctcccgcatccggcacaccggcagtcaggaaacagaactggcgaatgccgatacggtgctgcacatgcaggatgaaattctgttcattgccaacccgaaagatgtggaggccattgttgccttcttcggaagaaaaatttcggtggagtgggaacgggaggacaagaacttgatttcacgccgcatcctcatcaccaagccggaactgaacggcaagtctctgtctcagctcaagatacgtaacaacttcggtgcctgcatcacccgtatcaaccgttcgggcgtggatctggtggcaactccccacttgcagttgcagatgggagaccgtgtgacgattgtaggcagtgagcttgccgtgagccatgcggagaaggtattgggaaactcgctgaagcgtctcaaccatccaaacttgattcctatcttcctgggtattgccctgggatgtatcttgggcagtctgccgttcatgttccccggcattccccaacccgtgaaactgggactggccggtggaccgttggtggtttccatcctcatcagccgtttcgggcctcaatataagctgataacctacacgacgatgagtgccaatctgatgatacgcgaaatcggtatcgccttgttcctggcctgcgtggggttgggtgcaggaaagggattcatcgataccattatctacgaaggcggctacgtgtggattggatacggtgccatcatcacggtcgttccgttgctggtgacaggattcatggggcgctatttctggaagctgaactactatacgctgataggtgtgctgtccggagctaacaccaatccgcctgcattggcctattcctcggacttgacatcctgcgatgcccctgcggtgggatacgccacagtctatccgctggctatgttcctgcgggtgctgacggctcagttgctgatactggcgttggcgtagtttcaccatagataatctatggtacataggttgatttgataacaagtaatgtaaagggagctaacaagtaatgttaggctgctttacattacttgttatttttgtttgtagtattcctccgcttgtgccagtgtctccggtttgccgatgtcgaaccagcggaatccttgcagcggatagccttgtatgtgcacctttgtgcaggcggacaagtagaaaggaatgatggagaacttgccgttccactgcccatcgtccatcaggtggaagagggagggggagatgatgtggatacctccgaaggcgagttcccggtacttcgtttcccggtagtcgaagcctgccggtttcacctctccggtggacttgtttatccagccgtgcaggtggtagtcgtcgtcaaaaaggagatagcgggaagtcttgcgctcgctcacaagcagggtagactccgcatcgctctccagatggtggcggtagagacctgcaaggtcaatgtccgtcagaatatccgcgttgtgcaccaggaaaggttcttgtccgtccagaaaggggcgtgcctttttgatgcctcctccggtgtcgagcagcatgccgcgttcgtcgctgatgtgaatctccgtgccgaagttgtcgtgggcacggaggaagtcgataatctgctccccgaagtggtggatattgaccgttatctcgttgaatcctgcttccttcaaccgcagtatcacccgttccagcatgggctttcctgctacgggaacgagggccttgggcatgttgtccgtcaaggggcgcaaccgggtgcccaggccggcggcgaaaatcatggctttcatattggcatattctcacattagcacattaaactttggccttaaacgtctgttcaatattctgttctctatgtatcaggttcacttgcacgccgaacttcttgtgcagatgttccgccaggtgttgtgccgagtacacggagcggtgctgtccgccggtgcagccgaagcagacagacagattggtgaagccgcgttccatgtagcgcttcacggaagcgtcgacaagggcgtaggcatgctccaggaatacggctatctcgccgtcgtcttccaggaagcggataacgggttcgtccagtcccgtgaagggtttgtaacgctcgtacttgccggggttgttcacagcgcggcagtcaaagacgaaacctcctccgttgcccgtggaatcttcggggataccttttttgtaggcaaagctggtgactttcaccacgaggcgacgcttttgcaggtcgtctgtaaactgtttcagctcggtgagttcgcgcagaatccggcagaggtagggatattctggataaggttcttggagcagttggcgaaggttctcgatggcgaaggggacactttgtatgaagtggggcttcttctcgaagtaaccgcggaaaccataggcacccagcacctgcatggtgcggaacaatacgaagtggcgaagctgggcatagaaataagcctcgtccacgggctggtacttgcgcagggcgtcgatgtattccttcagcaactctttgcgcaggctgtcgggatagtttgctttggcttgccacaagaaggaggcaacgtcgtagtagaccggacctttgcgtccgccctggaagtcgatgagccacggctcgtcgtcctttatcatgacgttacggctctggaagtcgcggtacatgaaggtggcggagctgctacggagcaacacgtctgccatcttctggaagtcgtcctccagccggtcttcctgaaagtccatccccgtagccttgaggaagcagtatttaaagtagttcaggtcccacagaatgctgcggctgttgaactctgcctgcgggtagcagtaggagaagtccatgccgtcggctccggcaaactgcacggcgggcagcagacggatggtcttgcgcagtaactgtttctcatcctcgccgaatacgctggtcttgcggcctttctcgatggcattgaataggagcgagtcgcccaggtcttcttgcagataatagatatcatcttcggagcggatgaacacttgcggtacgggcagtcctttctggcggaaatgttctgccatgtagaggaaggcgcggttttcctccacagactctccgctgacgccgataagtgtaggacttccgatgaggcggaagtagcggcggttggagccggaggaggggagttcgtcaatctgttccggttcgtgtccggtatgtgcgatgtagagtttcttaagttcttcggttatcatggtggtatgttttattttcgcagctaagataaaacttttgttggagatatgcttatctttgcacgttgaaaatgtgctaatgtgccaatatgccaatgtgccaatgacctgcggcatggggaagtagcgcaagtatagcgcagccgattagcacattggcacattaaatcattaacacattaattatgcgttccatccctcagtttctcatagccgcccctacatcgggcagtggaaagaccaccgtcagtcgtggactgatggcattgtttgtgaagaaaggtctgaaggtgcagcctttcaaatgcggccccgattatatagataccaagtatcacgaggtggtatgcggccgtctttccatcaatctggatactttcatggcatctcaggagcacgtaagcagtctgtatgcacgctattcggcggatgcggatgttgccgtggtcgaggggatgatggggatgtacgacgggtacgaccgcgaccggggctcgtcggcagaagtggctcggctcttgggtattcctgtggtgctggtggttgatgccaagtcggctgcctattccatggctcctttgttgtcggggttcatcaattttcgtccggatatacgtattgcgggagttatcttcaatcgtgtcggctcgctccgtcactatcggatgttacaggaggtctgtgaagacttgaacgtgacttgtctgggctatctgcccaagcagaaggaactggagcaggagtcgcgccatctggggctggatttcagccgttctaaggagacggaggggctggacatgctggcaggcttgctggaggaacatgtggactgggaactactgctctcgacaaccgggcgtccattgcctacggcggcagtggaggagaagccggtactatcggagccggggaagctacatatctcggtagcgcgcaacgaagagtccttttccttcctctatgcggagcatctggatattctgcgccgtatgggcacggtcacttttttcaatccggagcaggaccgggctattccgcaagagacggatttgctctatctgcccggcggctatcccgagaaccgtctggaggaacttgccggggcaaggcttgccagggagtctatccgcagctatatagaggccggtggcaggacgctggcggaatgcggggggatgatatatctttcgcagtccgttctttctgatggggatacggacgggggaagtgccgggagctgtgtaggcaatattggaaatgagatggtaggagtattgcctttcagcattacgaacgagcgtaaacgcaggaaactgacattgggataccgccagttcaactataacggatggcggcttaaaggacacgaattccattatacgcagtttgctgtgcccgaggctgatggaaaagaaggtggtgcgtgcagtcttcctccctcgatagcgcaggtctacaatgccaaaggagggaaggtaaccactcccgtctttcgctataagaacttgatagccagttatacgcatctgtattggggcgaggtggatgtgatggctttgttcggtgaactctaaaatagcgcattgatattttatgtaatttcgtttgtgttcttgaaatagtggagtatctttgttttcatttaaatatattatgaaactgaatacttatcgcttgtcttctttggaagaccctactgatttatcaaatagagtatgaaaagagtctataccaaaactggagacaaaggaacaacgggtattcatggtggcacgcgcgtgccgaaagatgacatccgtatcgaagcaaacggatgccttgatgaattgaatgccgtgattggtatcgtgcgctccatgctggcggcaaaagatgcctggcaggagttgctgcatgctgtccagcgggaactgatggtggtgatgagccatgtggccactccctcgggagtggtgaaccctaatccgctttctgccgcagagctcacgctgcgctgtgagcaggagatggatgccatgaccgtcctgctgacggacaacggctacttccttttgcccggtggcactcccatatcagcccaactgcagtttgcccgtaccgtggcccgccgtgccgaacgccgtttgtggacactccatcgccaagaccctgtgaacgaggatatcctgcgctttatcaaccgcctttcggacttgttcttcgtcatggcccgcatggagatgcagcggcaggactggccggaggagaaatggcaggagtttgcctacaaaaggaaaagacagtaagcgcttatcgctaactgccgggaagctgttttcagcatagggggtctatttgctgtccgagccttaaatcatacagacatgcccgtacttccgcttcgctgccgatatgctttcctgcatcgtcggacagcttcacgcattcgcgccattcctggttgacgttcatcttgcattgcgtcagtttcattacgatgttggagggcttgaatccggtatcattcgtcagattggtgccgatgccgaaggagcagcggattttgcccctgcaatgctcctggatgtcgagtgccttgccaaagtcgagcgcattgctgaagacgatggttttagtggtagggtcgatgcccagttcgcggtagcgggcaacgagcttgtcggtgaaatcgaattcatcaccggagtcgcagcgtacaccgtcgaatagtttggcctgcttgcggctcaggttacttaggaaaatgccggaggtataggtatcggacagtgcgatgcccaagtcgccgtcgtatacgttcacccagttttccaaggccatgtagttggcgtgtttgtagccgaactgtgcgccgtggaacatgaaccattcatgcggatgcgtccccataggcttcatgccgtatttcatggcgaagtggcagttggaagtcccggtacagtattcggcggtttccttcagacggcctatgactttgtcctgcacttcgaacgagaagcgtctccgggtgccgaactccgaaaaatacagctggcgccggttggagagtgccaccttttcggaaagtttgcagagtatgccgtccatgtcggccacgtttcccaaagaacggttctttatttcggatacgatggcaagcagagggacttcgtaaagggtggccttgtacagatagtccgtgatttcaatgttcaggtgccggtcctcgtccagatggatgcttaccttctccggctggaagcggaaggaggagagccactcccaatagaccctcggcaggaagcggcagtggcgggtcatgtactccagctcttcggcagtgagtacggtttgtgtcaggctgtccaccgcctcttgcagttccttcagaaacgtgtccgtataggcggtgtcgtctctgtccttaaaactgaaagtacccatggcatagggaaacaatttgatgtaggcatacgaggtggtgaatttgtaaaggtctgtatcgagtatggtatgaatcatggcagaatattctttggtttacgattttggggatgaagatagtgaaaatttcttatttgaccagcctctatctgttaacaacggcatattcctattaaaccatgttataaataaggctgttatgggcggaaattttggagaattcggagaagtccgtatatttgcaatgtgtttttcatagtattagatttaaggttaacaaaagattggctgtctgggatagatagcctttttttatgccttcacttttccttctccgtagaggtggcgtgtagtgcagagcgccaaagttccatagaccaatacttgtatccacatcgtcagcatctgcggccatacgtcggccagcgttccacccattgaattcagttttacaaaagcaagtacggcaggacctgccggaaacagatagtgggctgcctgccaataccacggcatcagctccagcggataggacacgcccgaaaggaagatatagcccacagagaagaaggctatcatcagcaacggcgcttcggagtctgtaaaccagcgggagacggccagagcaaggaaactcgtgcccagcaggaagggtatcatcattgtgacgatgtctcctccgctgccgatgtgtgggatgctgaacaggtgcggcaacagtcccagcaggaatagggaaaacaccacgtagagcatgaagtatacgaaggtcctgcctccgacaatccgtaatgtatccttcaatgagtcggcacgcatcagccgtattccttttcttcgggcttccgcttcctcgcccgtcagcatggcaatcaccatcagcatcgtctggaagatgatgacaattaggacggcgggaatcagataggaaccgtagccctctgtatagttgtagagcgccgtgccggacacgctgacgggagcggacgaagccactgccagcagtccttgcggaggtaggaatacggtgccctccatgcggtgggcatcgttcacggcaagcatgacgcgcgcactggattcttgcagtcctttgaagttgaggaaagcgtccgtggcggcatagagtacgaagaccgaagtctcgccccgtgccacacgtgcctcgaagtcggcaggcaggtaaaggatgcctgccacgtcgccctgcttcatccattggcgggcttcgaggatgttgggtgtctggccgtagacggcggtctggggagtggcgtcgagcagccggatgtattcacggctgagggcggagtgggagaggtctaccactgcgacgggagccttgcgcaccaggttgggggcgtacatgtagttgtagagcagtccgtagaggaagataccgcctgccagcacgagcaggatggcgggattggtggcgatggcatgccactcgtgtcggatgacggaagctgttgacaatgaggtaggcgggcaaggtgagagggaggcggagattgcttcttcccttatctctttttttatccaccatttcagcaatggcagtatcagcagtgctgccaataggaagatgaagagtgtagctaccgactgccagaagtaggcaaaccctgcatcgaagtaaatcatggcttgcgccgcctccgtgaagtgccgcacggggaagaggtaggaggcggcatgcacgggcgcatacatggctgtgacgggaaatgtgaccccggacaaggtagctcccaacgaccccaccatggatactacactgatgatataggcaatcttgggaaagacagaatagataaagaccgccaatgcctgggtagcgatgatgaagagcacggtcactgcattcatcagccacagactgccagcgaaggggatatgtagcgggccgaacagtacatagtttgccaggataccaatggacgagaagatgagggtatagggcagcagtttccctgctacggcagtgaggatattgcctcgtgccatctccagccattcgccggcgctgccgaatttcagttcgctgcctatggagtagacggtggtgagcaggatgagtatctggaacagtacgaaaaagaaaggctggctcaggtagatggagtagtccatgtccgggttgtagaggggatgggtactggcttctacggggagcaggaaggtctgtatctgttctccgcttactcccagtgcttcggcctgcatcacgatgggggagagtgcaacgggagcaagcgtattctcgaacgccgccatcagctcgctgcctaccgagaggagggcatagtggtaataataggtgagcgttgcgtcagttcccgtcaccgccttctgttcgaagcggggcgggatgacgaggtagccgtatatgtccttccgttgcaatgcccggcgggcgtcggcttcgtcggtgaagtgctccgtcacacggaaggtgggggcggcagagatgcgccgggagatattgcgcgaagtggcagtgttgtccaggtcgacgatacccacgggaatgttctccatctgtccgtttccgaagatggtggccatgaagaacagacagaacaaaggcagcacgacgcagacgccgaggtatagacggcgggaggtcatgcggtgccattcgcgacggataaccatgcggagcgctttcattgcgtagccaaattctttatctttcattttttattcttcatttttaagagtacggacatccccggtctcaatccctctacctgctgtgtgggacgtgcgtgtatctcgaacgtctgcatgtcatagctgcccgtctgtttggtggatttccaggtggcgaagctgcccagcggactgatgtagtagatgcggaattcaatgtccttgccgtcgatggcggggacatcggcacggaaagtgcctcccatcttgaactgaggcatcaggtcctcgcggatattcagtaccacgtgtgcatcgtccatcacgacgaggctcatgatgggagtgccgggagccaccagttctccgcgtttggggaagatggtagctatctggccgtcttcgggagcagtcaggcgggagtcgacgaggagggaggagacttcatcgacggtgcttcgcgccgcttccaccaggctgcgggccgaggcgcggtcctcgctctgcgctccgtctacggccatctggtattgctcgtaggcggcacgttcggcggcttgggcagctttgtatatggcctccacctcgtcacgccgctgggaggtgacgacactgtccttataaagcgttacaatgcgctggtaagtggtcttggcgagggcaaggtcgctctgcgtcttgttccagagttgccgggcagtggccacaatctggcggcgggtaccggcgtctatcttcttgttctgctcctgggccacctgcttcagggcattcacctggcggtatttggcttcgatggtggggctgttgatgacgacaagcgtatcgcctgccttcacccagtctccctcttgtacgaggaaggagtccacacgtccgggcagcttcccgctgatacgtatttccgttgcttccacttgtccttgcaggactaggggctgccggctcatgagtaatatgccggcaagcgaaatgatgaccgttgcggccaggataatgacgaatgcaatgctgatgcttttattattgattttcataaagggtaggttttaataagttgtctcgaaatatttctcgaaccgttccggcgttccgcagatagccagcaggttcatcagtgccacatcatattcgtagtaggctgccagacgcgccacgcggacggttgccagcatcgtttccgcatctacgacctcggtactggttgccatgccttcggcaaaggatttcttgcggattcgcaccagctcttcgctcagctcgatggtggtattcaaggcgcgtacgttgtcttgtgccttttgcagttgggtgtagagcttgtcgatgcctacgctcaggtcttctttggctttttcttgtcccaaggcgagggtttgctgggctatcttcgactggcggatgcgcttctcacgcgccagtccgtcgaacaggttccaggtgaagcccacacctacgatggtgcgggggacaagattgctttgtatgccgtgggcatagagggtctgcttgccgaatacggcgatgtccggcaggtagccgctctggtcgatgcggagctgctggcgggcaatctgtgactgcagttgcagttggttcacggtgtagttctccacccgcatggcttgcaggaactcctctttagcgggcagttggtcgttgatgaaaagctccgaagtaggatggatgctgcatgtgtcttgcaggttgagcagggtgcgcagggcactttgtacgacggaggcctccttccgggcagcctccagtgaacgggcagcttcatccatattcacttgggcaaagagccggcctgccttgtctatcatgccggcagcttccagtttaagggcattctggtaatggcgttgcaggctgttgtaggtctcctgccgcacgcgtactacctcttgcgcaagtttcagcccgaagtagctttctgccagcagggtgcgttgcgtggcatcggtctgtccccggttttcgcgggcaatgtctatcatggtgttgcctatcttcgaggcccggatgcgcttgccgccggagaatacgacccattcggcggtcaggccgacggaagtcaggttgcgtggagccagtggaaaagcgagggtatgggagcctatctggtcgagtatgctgctgatgaattggtcgtccggcacgatgttgtgcacaaagtcttttgccgggtcggtgaactgggaaaggggctgttttacctctatcttttcggaaagatgcacgaacgtaccggcaccttgcagggaggggtaccagagggcattcagtttgtcacgttccgcacgggcggcttcaattcccttgtcggctatttttaggctgcggttgctgttttgcatctgccttagggcatcaccgaagctaaggggaagggaggtttgtgcggccactccaccgatggcaagcagcacgcaggcagcagccggaaaaaatctccggcataatagattattcataagttcgttcggtttaggggttcttgtttctctaaacaagaggaggtgggaattgttcagtagtcatctttttgaatagaacgttacaaatataacgaatagtttccgaagatatggcttatgaatgggagagatattcggatttgcactatctttgcattcgctaaaatggaatttatggagaaacttcatccgattatgtttgccgggacgggcagtgatgtgggaaagagcatcattgctgctgccttctgccgcatcttcaagcaggacggctatcagcccgcaccgttcaaggcacagaatatggcgctcaattcattcgccactcccgaagggctggagataggccgtgcccaggctgtgcaggcggaagccgccggagtgccttgccacacggacatgaatccgctgctgctgaaaccgcagtcggaccacacctcgcaggttgtcctcaacgggcgtcctatcggcaaccgcaatgcttatgagtatttccgcaaggaaggacgcgacgagctgcgccgggaggtttgtgctgcctacgaccgccttgccgcccgctataatcccgtcgtgctggaaggcgcgggaagcatctccgaaatcaatctgcgggataccgaccttgtcaatctgccgatggccctgcatgccggagccgatgtaattcttgtgggcgacattgaccgtggcggtgtgtttgccagtgtctatggttcgctgatgttgcttcgtccccatgagcgggaacgcattaaaggaattcttatcaacaagttccggggggatatacgtctcttcgagtcgggcattacgatgctggaggagctttgcggcattcccgttgtcggggtagtaccttactaccgtgatatctacattgaagaagaagactccgtggcgcttgccgcaaagtctgtccgtgccgagaagggaaaggtgaacatcgccgtcattctgctgcgccacctcagtaacttcaccgattttaatgtcctggaacgtgacccacgcgtacatctcttctatactaacaatgtggatgagctggcaaaggccgacgtcatcctgctgcccggctccaagagcacacttgatgacctttacgaattgcgccgtaacggtgtggcggctgccatcacccgtgcccaccgtgaaggtgccaccgtgatgggcatctgcggtggctatcaaatgatggggcaggaggtgctcgaccctgagcatgtggaaggagacatcgaacgcctgcccggactgggactgttgcccatcagtacccgcatgtcgggagagaaggtgacccgccaggtgaagtttggtctgtgcaatccccattctccatcttccactctccgttctccattcatgcagggctatgaaatccatatgggagtgaccacccccgtggaaggcgcccccgattctcccctaaatcttttggagaacggctctaccgacggttactacgtggactccacctgcatggggacctatattcatggcattctcgacaatccggaattcatagatttcctgcttgcgccttttgcagacaaactgtccgggaatgccggcgctttcgattaccatacattcaaagaagaacaatacgataggcttgccgagcacgtgcgccgccacgtcaacctgccgcttatctaccaaatattgacaaagaaccatgattgaaggacacggagacgattcctataaatacagccgtcccattacggcaaacttcagctcgaacgtttacaacagggtagacctctctgccttgaaggcgcatctgtgtgcccggattgacggcatcggcaactatcccgaaccggagccttacacgcttgaggcctgccttgcccgctgccaccgtcttcctgccgaggcagtgtgcgtgacgaacggagctaccgaagccatttatctcaccgcgcagactttccgcgggacaaacaccgccattgtgcagcccactttcagtgaatatgccgatgcctgccgcatgcacggccatcgggtcacttccctctatcggcttcctgcggagagcgaggggtatcgcttgccggaagaggtgcgcatgctgtggctgtgcaatcccaacaaccctactggaacggtcgtggagaaggaatatctggcaacacttatcagtcataatccgcaggtatgtttcgtcatcgaccagtcttacgagtttttcaccttgcgtccgcttttctctgctgccgaggcggcggaatttcccaacgttctgctgctgcactccatgaccaagcgttatgccgttcccggtctgcgactgggatatgtcaccggcgccccccacctgctgcaccgcttgcgtaccaaccgtatgccctggtcggtcaatcagcttgccattgaggcgggactccatctgttggaacatgatgttcccaatccgctggatgtggcgtcttacttgcaagaggctgcccgcctgcgcagtgcgctcgaggcattgggaggactggaggtatgggccaccgaaacccatttcatgctggtgtgcctccgtatgggcaaggcttccgccttgaaagactatctggccggggagcatggcatcttgattcgggacgcctccaactttgacgggctgaatgagcacttcttccgcatagccgcccagagccgggaggagaatgacaggcttgtaaaagcaataggacaatggcttgaggaggaataaccgatggaagaagatgtacttatacttttgggtgtcgccttcaacttgaacctgccgcttctcacagcctggctgctcgaccactggctgggcgacccggcgtggctaccccatccggtggtggctttcggcaaagccatttctttctgtgagcaccggttgaaccggggcgatttgcgttttctgaaaggtgcgtttgtggcggtgtctcttgtcttgggggtatacgtcattacgcttttgttgctccgcttggcggcactcttttctccgggcatgcttctaacgctgcaaatattgctgatattctattgcttggcgggcactacgctggttcgcgaggtgcgtatggtgttcaaggcggtggaccgttccttggaggaagggaggatgcaagtggcacgtatcgtagggcgtgatacgtctgcactctcggcgcaggaggtgagaaccgcggcattggagactttggcagagaatttgagtgacggggtagttgcccccttgttctggtatctgctgttgggagttccgggcatgcttgcctataagatggtgaacacgctggattccatggtcggctacaagaatgaacgctatcgtcggttcggctgttttgctgcccgtttggatgatgttgccaattatattcccgcccgtctgacagcctttctgatggtactggtttccggtcgcctttccttgtttgcttttgtgggcagatatggcagccagcatgccagtcccaattccggttatccggaagccgcccttgccggtattctggactgccgtttcggaggtccgcacaactatttcggcgaggaggtatggaaaccttatatcggttctaatgaacggcctctgaagacagaagatatgcgtgtggctgtccgcatcaaccggcgtgtggagtggtggatggtggttgccgtaatagtgacatcgaccttggcttccttttgtttttaaaatgttgttattttaactgattctttgtccgttccaaaaagatataatatctttgcaagaccgcgttgcattaaaaatgtaacttttaaagcagacaaagtcttataaatgaggataaagcaactatatatattccttttctttatttggttcgggagcacaataattgcatcggcaacagataaagcggattcttggactaaagaaaaggaaagtatagtccatgaggtcatctccacttttcacaacagcctcggtttcgactatctgacccgggaggagtgtgactcgctgaatgccgacggccttttgtcccaattggatgaatcccagcgctattacacctatttcgaactggaaagaatacttataaaatcctcccttttccgtggagaaatccgtatggccattgcccagagcgaccagatgtactccaaagcccgcgcgcttgcctaccccttcggcaatgccctggcgctgaatgccatgggagaggtgtacagctataccggcaggcttcgggaagccggtgccgcttacgaagagtctttgagactgctggatgggatggacggggaggatgtgcatatccgcatgctactggtggaactgatagattataacctgcgcatacggaatgtaaacggtgcctcgcgttatcttgcacgtctgaacctctatccggaagaccggctttctccgctggagctggccatgcgtcacatctccaatgcttcctgccaattattcaagggtgacttgaaagctgccagccattgtctggtacagataggccagcttgaagcgcaactgattccggagatacggcaataccttctgattatagatgcccgttatctggtggccaccggagagcatgaggcagccttgaccgcctacaatgatttccttcaaaccgaatatgcccggataaaccataacatctacaaggaagctctgctcgaaaaggcggatttactggtgaagatggggaacaaggaagaagcctacggacagtacggcaaggtcttttcgtatatcaagacttcgttcgagaagaactatcccaaggagatagaccggctctgtacccgtttccaggccgaccaactggcctaccagaacgaacgcgaccgcattgtatccatgcgtttctatctggcaggcatcattgtgtccgtactgtttctgatattcctcctggtgctgggctggaagaagatattccgtttgaagcgttcccagatgcggcaggaggcgatgaaggagaaagcggtgcaagccatacaacggaagaatatgtttctttcgaacatgagccatgaggtacgtacgccgctgaatgccattgtcggattctcggcggtactgacggatgaggacgagtcattcgatgacgaatcgcgccgggaattctccgaaattatcaaggtgaattcctttcagttgctgaaacttatcaatgacattctggatttctcggatttcgagaatgacaatataaccttcaacatccgcacgcatgatgccgtgaagttgtgtaatgaggtcgtggagaccgtgatggcctcgcgcaagctggaggttgaaatgcgttttgacacggatttgtccgtcctgatgctggatacggacgatgcgcgcctccgccaggtcttgataaacctgctggtgaatgccgccaagtttacggaacaaggctccatcgtgctggaactgaagatggctgatgccggtacggcacttttctccgtgacggataccggatgcggcattccaccggaaaagcagcacttgatttttgaacgctttgaaaagctgaatgattttgtgcagggaagcggactgggcctttccatctgccaactgattgtgaaatatatgaacggcaagctgtgggtggacagtgggtacacccgtggcgcgcgtttctgttttacgcatcctttgaagtataatcccgcattacacggaggaacggcgcaatgaaacgaatactgattctcatccatgttttgttttgcggatatatctgtccgctgctggcagaagacacgggggctgtccggtatcaggacagcatcctgaaggttgccgataccctgccggccacccttgtccggctgacgtatctccgtgacatggcctacaagcaccagtatgctccctataacatgactttttccacccgtctgtacgaggaggcgcggcggcagaagaacgctttctatgagaatatgggcgcttactatctggcggcatgttatgacaagaaacacgacccggacagtctgtcgtattgggtggatgtgctgaaggattttgtctcccaggtaggcacttacgattattatctggagcagaaggctgccatcagccgcgccctggcttccaagagacagatagagaaagcggtgtatgtggctaaggagacgttggaggaatcaaaactccgccatagcaataacgggatgatagcggcgtataacagtctggggtgtgcctacggagtgtccagccgcccgaatgaggcactggacgctttcttggaggcttaccggaatttctctccccagacaaagaccagcctgaaagtggatatactgtcgcgtattgcccaggtatacggcaatggcggtaaagacagcctgaagctgccctatttgcatgaaatggacatgacgttgcagacggttatttccaaagaacccgagacaaggaagaactggagcaatttcgagattgactgcgaagtgaagtatatcctgcactacatgaaccggaagaactttacagtggcgcacgagcatatcgagaaagtaaagaaactgcttgaaccgcatgtagatcccgtcttctggctgaatgtccagttgatacagcttcaatattatgccaagaccgatgagtatgacaaaagcatcgcattgatagacgaggtgacccctacggtactgaacaactacgtttccacctttgccactttgataaactacaaggcgagtacgcaatatgacaagggggacattgacggggccatcgagccccggcgctacctcatacgcaagcaggattcgctgaacaatgccttctcggccaaccagttgaagcaggtgaaggagatttaccacattgacgagctgttgttggagaagcagaagattcaggacatgaattaccgtataggatttatattcctgggcgtctgcctgctgctgatgctgcttttctacttgtatacgcgctatgtctccggaaagattgctgtcgtagagaagaagacggctgaagccgctttgcaggcagagacggacaacatcgcgaaggaacgtctgaaatcggaaatcagccatgatatacgtactccgctgaatgtggtggtgggctttgccgaattgctgaccggaaaggaggagctggataaggagactaagagggaatacgggcagatgattcagaccaatgcggaaagtctgctgaattatgtcaacagcattctggagttgtcccgcctggagtccggcaagattcagtatgaggacgaggagtgtgacattattcagttgtgcagtgaggtgctggataaagtgaacagccgtgaggagagcgctgtgtctgtcagcctgcagaccgacctcaaggaacagtttgcgaggacagaccggagatggttcgatacattgcttgtcagcatgctgactccgtcagagaatgatactgcccgttatgaggcgattatccgcatcagacgggaccgcactaggtcggccctctatttcgatgtggtcaacgccccgtttgcaaaggtacattttgagaataaaacgagcttgattcgccatgaaatcaatgcccattttattcattattttggaggtatctacaaggtgcaaaccgaagcggaggaaggccctactatttcgttcactattccttgtcgagattgatgcggacgatgccgccgtagggcgtcaatgcgtcgaaggcttcttcggctttgaggattccggcatagagttgcgcgcagatgagtacgccgccatgtgcgaagatggcaacgcgtgtatagggcttcttcctcaactcgtccagaaactggccgacacgtcggtattgcatggcaaaggactctccaccggtagctgccacgttcatgtagtcggcataccattcctgcaagcgtgggtcttcattctgctcgaacggcttcatctcccagtcaccaaaattgatttccataatccgtttgtcccgttctgcatcgggatagccgcaataggtggcgaggcgcacgcaacgggtcaggggactggtgtagacgtggtcgaacggaaggtatgccttcaggttttctgctgtcacggcggcttccgcttcaaacgtgggttttaggggaacatcggtctgtccgtagcatacgcccggagggacatctaccgaagtgtgtcgaatgaatattacttccatctttaatttttagttttaatttataattaggataaggcttcccaaatagaaggacagttcgcatagcaggaaagtggccccgcagcagtcacccgtatatccttgcaggcgccgcttcatcaatcggtagagcaggaagaaggtgagcagtgggaagagggtggcaatccacagctttataggcagcagcagtacgaaaggaagcagaccgcaaagaaatccggccagtaactcgtaccagctcatgcggttgtagacggtcttgcttttgctgtcttcctctttccgggcatagggcagatagttgacaatctgggaggcacagaacttggaccagcagtcaccgcagagcacaaggatgcagagaagtcccagtggcaggtgatgaagttggagcaacagcaggaaatagcatatcaatccgatgacaccgtagcttccgatgtgggaatccttcatgatggcaagagtccgttctcgggtggtaccgccaccgaaaccgtcgaaaaagtctgccagtccgtcttcgtgcaggcatccggtgacaattaggcgtgcgatgagggcaagaatccatgccaatgacaccggcataatctgtccggcaagccacagcactgccgccatcacgcctcccgtcagccagcctacaagcggccaatagggaaccacatgcttgaaacactctgccggtacttccttgattttccagaagggcagtcgggtgagcattatgaatgcagccaagacattgttcatattaaaagtatttagtgatggaggcatgtgcaaagttatccatttcattgagcatccgcacggccgagtcgacaatgggatatgcacagatggcccccgttccttctcccaaacgcagtcccaggttcagcagcggacgggcatgcagggcgtcgagtaccagtttgtggcccgactcgtctccgcagtgtccgaagatggcgtaatccgtcacttccggatagagcctggcggcggcaagcaggcagttggtcatgatgaatccgtctacaaggataatcatcctcagctcggcagcttgcagcatggcgcctatggccatcaccatttccagtccgccaaagtagcggatgatgtctcggggagagccgtcgcccttgtagttctccatagactgcttcaacacttcgtatttgtggcggatgcccgcgctgtcgagtccgctgcctgcgccgacacattgttccagaggaataccggtgaagcaggtcatccacagggaggatgaagaggtgtttccgatacccatttcaccgaagctgaggacattactgccttcttcatggcattggcgcaccacctcggcaccccgttccaggcacatctccatttcctcttccgtcatggctgcctcgtgcagataactccgggtgcttttgcgcactttcatattgatgatgcctttctcgtaggggaggtcgtagtctactcctgcatctacaatcttcagggtaaagccgtgctgccggcagaggaaattgacacctgcccctccatgaaggaagttgctgatttgctgccaggtgatttcctttggagacagactgacaccttcttctacaatgccgtggtcggcggcgaagataatgttttgcggatgtttcaaggcgggggataatgtctgttgtatgagtccgatttggagtgccagttcttctaaaatgcccaatgagcctttgggtttggtcaggttgttgattttgtcaatcaatgcaggacggattgactcgtccgggcgggtgatatgaaatgttttcatcagtctgttgaattttaattgtctgttgttttatgaatgagtgttttttacggtaagtgggatgccggataccatcagtatcacttcgtcggtacgggcggctacatattggttcatccagccttgcatgtccgtgaactttcgttgcagttcgttctcggaagttcctcccatacctatttcattggttacaaagatgaaggttgcgtcttgtgccgtgaagcggtcgaactccgcctttactgcggcaagtgcccggtcggtatctgaatgcaggtcgaagaaaaagttggtacaccataaggtgatgcagtctatcaggacgacccgcccctccagccggtggcggctgagttctttctcctcttcgatgtttgtccattccggtccccggcgttcctgatgccggattaccctctggcggaattcttcgtcccagatgcgtgccgtggcaagataaacgggagtgggagagagctcgagtgccagcttttccgcataggtgcttttgccggaacgtgctcctccggtgatgagtatgattcgtttcattggtatttagtctgtattttgaaagaatatctttgttttcccgagcaaaaataagaaatatttgacgaaacgtttgtttttttaggaagtaatttattaactttgccaccgtttttaaggcatgaccttggaaatgtttatgcggcagtagctcagttggtagagcatcagcttcccaagctgagggtcacgagttcgagtctcgcttgccgctcctccatttagagttaggcagttgcatcacagcggctgcctttttttaaatatcgaggaaaatgttcgggtcaagccattttaaacgtaggaaaaactttaaaaaacgaaatagaatggcagtagaattgaaagaccttaccaaacgtagtgagaattattctcagtggtacaacgagttggtggtaaaagccgatttggcagaacaatcggcagtacgcggctgtatggtaatcaagccctacggatacgctatctgggagaagatgcaacgtcagttggacgatatgttcaaggaaacgggacacgtcaacgcttatttccccttgcttattccgaaatcattcctcagccgtgaagcggaacatgtggaaggctttgccaaagagtgtgccgtcgtgacgcactatcgtttgaagaacgacccgaatggcggcggtgtggtggtggaccctgctgcaaaactggaagaagagctgattatccgccctacttccgaaaccatcatctggaacacctacaagaactggatcaattcataccgcgacctgcctatcttgtgcaaccagtgggcaaacgtgttccgttgggaaatgcgtacccgtctgttcctccgtaccgccgaattcctctggcaggaaggacacacggcacatgccacccgcgaggaagccgaagaagaagcggtaaagatgctgaatgtatatgccgagtttgccgaaaaatacatggcggtgcccgtggtaaagggcgtgaagtctgccaacgagcgttttgcaggtgccctcaacacctacaccatcgaagcgatgatgcaggacggaaaggctttgcagagcggtacttcccacttcttgggacagaacttcgccaaggcgttcgatgtgcagttcgtcaataaggagaacaagctggagtatgtttgggctacttcctggggtgtttccacccgtctgatgggagcgcttatcatgacgcattccgatgacaacggtctggtacttcctccgcacctggctccgatacaagtagttatcgttcctatctacaagaatgcggagatgttggctaagattgacgagaaagtggcaggcattgttgccaagctgaagtcaatgggtatttccgtgaagtacgacaatgccgacaacaaacgtccgggcttcaagtttgccgactatgaggtgaagggtgttcccgttcgtctggtgatgggtggccgcgacttggagaacaatacaatggaaatcatgcgtcgcgatacactggagaaggagacgcgttcctgcgagggtatcgaagagtacgtgaaggatttgctcgaggacattcaggcaaatgtctacaagaaagcgcttgattaccgtaacagccgcatcaccagcgtggacagctacgaggaattcaaggaaaagattgaagaaggcggcttcattctggctcattgggacgggactaccgaaaccgaagagaaaatcaaggaagagaccaaagcaaccatccgttgtattcctttcgattcatttgttccgggtgacaaggaaccgggcaagtgtatggttaccggcaagccttctgcctgccgcgtgatttttgcacgttcctattaataatacccaccccggattacgcggattaacacagatgattttaggagttctgataatcagaaacttttatctgtgtcaatccgcgtaatccggggtgattgtatatcttgatacgtcctctcggttttaaatttatagagttatctctcatcatgaattgatgaacagctatttatattgcttcagaaattctgagattgttttgcgtacagtttccggagattgttttgaatgaagcattgctgcaatgacaatcctattctcatcaatcaaataatatatcacgttaggggaaagttttaaatgacggacagtaatgttgttaaatagagtagaaaaatcactgtctataattcctatatacggatgttttgctaaaagatttactttgtcttgtatcttttgacgtgttttctgtgccgtcaacatgccaaaattattctctacataaataagtatctctaaaaagtgctcataagccaacttagaccagactatttccatcccatgcgttcatttatcatactctctatttgggagtttgatatacagtgtcctgctttattctcttctaaggcaaatagaagggcttcagccaaagcatctcggggaatactgttgataaagtcgtccatcggtatggctgattgatgataagttgccatcatcggttcttgtgccgtttgtttggaagagtcctgctctttatatggtttaattttacccattgcttttatttttaatcaaaggtaaactgaataaatgaaaactcctaatattcaatccatttattttccactgcatcaaagccaaccaatctacatacttttgtaacctccttcacatcttctcgtaacaactttccctcatttttgcagcgtaaaaaaagaaaggaggcccgaatatgaaactgaacagaaatgactataccgtagaggcggcagccggcggtggtttttacgcttattttatgaataatgtgttgtgcagcgcctacggtgaaacgcctgacgaagcctgcgaaaacctggaacagattgttgacgattttgtcagtgatatgtatatggtcgaggaatttgtctgatgctccggcatcatatgccgaccgaattatcctttttacgtatttattccataaattctcttgaagtcatgtctgcgcgatgccggtgtgacttttgtcatttataaccgaattgtcacattcttcacattctgccgtaacacggaggtgcgatatttgcatcaactaaatgcaacgtcatgtgctgcatgtgtttcaacattaatttgtaaatcatcaagtcgtcccaatgaaagtcctttttatcgttcaaggagaaggccgcgggcatctgacccaagccataacaatggaagagctgctgcgccgcaacggtcacgaggtagtggaagtgttggtgggcaaaagcaattcgcgctgtctgcccggtttcttcaatcgcagcatccaagctccggtgaaacgttttctcagtcccaatttcctgcctacgcctgccaacaagcgggcaagtcttgcgcgtagtgtggcctataatctcacccgtctgcccgtctatctgaaaagcatgcactatatacaccgccgcatcgaggagagtggtgccgaactggtcatcaacttctacgaactgctcacggggatgacctatctcttcttccgtccttccgttcctcaaataagcgtcgggcaccagtacctgttcctgcaccgcgatttcgagtttcccggtaagaacggcttccatctgtggctgctccgccttttcacccgcctcacgtgcataggtgcccgcgaaaagctcgccctttccttccgcgagatggaggatgacgaagaagcgtatgtccgcgtggttccgccattgctgcggagggaggtgctgtcgtgcgaaggtacggaaggggattatctccacggatacatggtaaactccggttttggcgagaatatcctccactggcacagtgcccatccggaaatacccctccacttcttctgggacaagcaggacgaagccgaggtgtgccgtgtggacgacaccttgagtttccatcagctcgatgacgtcaagttcctgcgctacatggcaggctgcaaggcctatgccaccactgccggcttcgagtcggtctgcgaggcgatgtatctgggcaagcctttgctgatggttccggcgcatatcgagcaggactgtaacgcctacgatgcattccgtagcggtgccggtgtcatctccgaggagtttgatttggaacgtctgctggacttctcggagcatttccacccgaacatggctttccgctattgggtgcgtagctgcgactggcgtatcctgcgctgtatagagagggaagagaaagaggaaacctttttcggggtttcctcttcctgccgtcctttctttccggcgacttaaatgttcacgttcatcgcattggctcccaatgcccctaagatggcggaggctactgcaattacgactttcagaattttatcccagatactttttttcatgctatatacgttttaaaagttgaacatacgaatcggtagtaaaatcagtcatacttatcccaacggattttcgccctggtctccgtccgaaccgcctccgtctcccgagccggaaccgccgccggagcttcctccttcaccgtctcccttgttcaccaatgcttccaggtcgtagaagtcaatcttctgcccggcacgcgtggcggcgatgtccggtcttacggtgctggaaggccggaaattgattttcaccgccttgatgttcttggcggtgcactcctttacatccagtacgcctgccgtacgcgccgacaggctgaatacgccgaagttcttgatattcactgactggccgctgtagagggttgttatcatagcctccacaaaattggtcaatacactctggatgtctcccagtgtcagcgaactcttctccttcatcacgtacgcaatgtcgtccagcgtcgcattgtcgcccagtgtcaccagctgcgggtagaactttgccaccgcatctgcctttcgaggatctttcctcgcaattttcttgaatggtactcccataaacaattaaataattaaaaattaacaattagaaattaaagtcccgtattgcaatactttgctctttctcctttaggggggaagaggggtgctgcaaaagtactcctccggctttttctgctcatggttttcttcgggttacgccgtctctttcccgtttcctttctgttcaggaaaagttcttcgtccgatgcccgtttatgtctgcatatgcttggtcatatcactgatattcagtatctttatggtgtaataatcaaccaataacataaagaatgaaaacagaaaaagaaaagagggaagaggaggaggaagaccttcgtccgttccgcatccacgcctattcgaaggaggagcttgccatgctctacaacccgacttactgcatcagcaatgccatctatactttggcggcatggatacgccacaacaaggcgctgaagggtgagctggagaaggtgggctacaacaaataccgacgcaccttcactccgctggaagtgaaagtgctggtgaagtatctgggagaaccctgacaggatgccggccggaaatagggaagccgtgtaaggaaaacgccaatatatgtaaagccccgtaacaatatatgttgtcatgcacaacaatatatgttacggggcttctctcttctcctcgaatgccggttactgatatagctggatgtccactacctcatattcggtcgtctcctgctcgttggtccgtgtaccgaatccgtacttttccagtgcctgcaccagtaccagctgggtgtgcgggttcacctgcacctttccgaatatgctgagcttggtcagtatgacgctggcagggagccattttatctgcaggtcctcgggcagcggtttgcggaagaagacgaagaggttctcctccacggggtctttcatgcggtgccgttcgttgtgcttgttcagctgttctatctcctcgccctcgtaccagtatctgaaaccgtctttcagcaaggcgagcgcctgggcgtagatgccgggatggttcaccggggtgtggtagtctatgccggtgacggtgatggggaggaaacgccggtttccaccgatgtcctgcaggcactgccggttgttggtgctcgcgatgaaggagcagtggcggggcagggtgaaggcttcgatgtcgtaggccttgcgctgcgtcacgttgtcctgcgcgatgattcgcttcaatgctgccagctcgccgggcttcacgccttcgaactcctccatgttgatgatgattcgcgtggcgagcaggcgggcatcgtccttgttgctcgggtctattatgccgttgtagaagtactctttccactcgggcggcagcaggcgccgaatccagctgctctttccctttccctgctcgctgtagaggatgatgacgagctggttcatgtcctcgtcgctcagtgcgcaggccaccaggcccactatccaccgtttgaagcccttctgccatagctcccggttctcggtcgtcagggtgtcggcaagttgggcgatgtagtccgtcccgtcccaggggggaagcgcgtacagatagtcggtgtaggggttgaactccttggcgtagttggagtctatcacggctctgaggaaattctggtagcaggagatgccggccatctgcaggtctacgaatatggtgttgtagtcctttccgcgcatggggcggtaaccttttccggcatctgccgacagggcatagggcatgaattcgaggcggtccaggatgaggttcctgcggatgccgtagtgctcttccagaaagctcatcacttggttgatgacgggctttttctcttccttctttgtggcggcttcgctggtcttgtcggtatagatgtaggcattgtgcaggggagattccacgtcgggatactcttgtccgaactcgtttttcgccagtctgatggctgtctgctcgtccaggcccttgctgtagcatttgttgcccagggcgaagaggaagttgtcgcggttgcctgcccggaacctggtggtgcgcttcacggcagtcacggcttgggagaatatcagcttctcccaaggctttgcgtcctgcggtgtggcggcagaggaggcggggagggggtgtaccgtttcgacgggcgtctttttggggctgttctccttcttcgcaggcgggatgatgcgtgccggcaacggggaaatctgttccagcagtgcggcattgatataggcatgcgggtcgaaggacatgaagtatcctcgcgagatgtcctttccgcttccatccacctctactccgagaagggcctcgtagtactctttggcggcgctgtacagcttcaggtgtatctcctcgagcgtggcgtaggtcacctcgccctgtcggagacggtcatacagacgccgggtgtattccgtctgcatgaagacgaacagcttgtagccgtgccttttgggggagaggaaactccccagggtgtgcgggtcttcgttgatgagggtccgggtctgctccaactgtctctcttccaggtcgtcgatgtcgagcgtgatgacggggttgtagcgggtgatgctcggtgcgagccttctttcccggtagttggccgtgagggtcctgaagggaagctgcttcttgacgtggttggcttcctccacctttccctgcgccacgaggctggcgattttgatgattaacttggcatgcttgccgtttcttatgtcagccatgtcctgcgtgaaggttgtctccccgctgacggcgctgaaaccacggtaggtggtaactggaatgttttccattctacttgtattaagtttgccttattggcggcgcaaagatgccgtttatttccttaggaagcaaaaacggccatccgcagtgggacagccgtttttttacaatttgaattccttggtccgttttactccttgggatatagctcattgaagagcttatatatctcatcctcaatgcaatcggggttcagcgtattgccgcttccgtccgcgtccataaagtttacaagtagatgcagcagcttggcgaaggggcttacacccttcagtccgtgttccttttggggatttatcagcagtggtatgaagggtgtcaggaaagccttccgctccttgtattccacggttaacgacttgtgttctaccatagaaagcaggtcgatggctacttgcacctctttgctctctttggtgtacagcacttggtaatctctccctttgatttgcatcacgctaattggcgtttttttgttctcataattacaatttgaaaatataattttatattaagttagtaaatcggttgcaaaattaacaaaaaaggagtctgtacaattacagataacgcagattttatgtttttcttacctgatgcaacgcttctaaggacgtgaaattaaataatccgtgtcatctgtgttatcagcgtctgaaaaattatcataaagcatcatctgctgaatagttacgaaattctgtggtatccctgtgaagtagtgaagcgtgtgtgtagtctgtatgtatagggtgaggtaccggaacctatggttatatatgtaacacactctttctttaaaaaaataagaaatgacgcgcgtgcgcgtgtatcttacctaatgagcgtaattatttgatatatagtgcgatgatacctgcattaaaaaagattatcattttatcaatcagaatattttgtactttcatttcttgacattacctttgcgttcattaaacggagcgtgtcataaaacattttttttattataaacgtttcgtttataacagcttatcgcaagatagcttgaatataactatttcgtcgccttccttccgagatggtggagggttttgaaataaaatgaatgcacatagtctatttaaagtaaccgcattacattacttgaccgggaggtacttcgctactccggtgtcccccaatcatatttttttgtgaacgagaatgcagaaatgcactggtatgcagtgcgtgtcacctatagccgagagctttttttcaaggattacctggatgcagcgggcattgaaaactatattcccatgcgctatgagtatgtcgtgaggaaagagcgccgcctgcgcaagcttgttcctgcggtccataacctggtcttcgtccgctccacccgtgagcgtatggacgaaataaagaacaaaccgggcatgaacatccccatccgctatatcatggaccgcgaaacccgtcagcccatcgtcatcccggactcgcagatgcgcagcttcatcgccgtgtctggcacctacgaccaggctgtgctctatcttgaacccaccgagctgaacctctcccaaggaacccgggtacgcatcaccggcggcatcttcgaaggagtggaaggggtgtttgtgcgtgtgcgccatgaccggagggtggtggtaaacatcgagggggtgatggcggtggcgacgacgtttgtgcatgcgtcgctggtggaggagatcgaataataatttgtaacaatattgcccgaatctttgaaaaataaagctgtccatggtgcgaagtggagctttatcgataacatatccaattccggtgttacctttttggtaggcctgatattggcccgtctcttgactcctgccgaatatggcattatggccatgatagctatcttcatagcggtgtccaactccattgtcgacagtggtttctctaatgcactgatacggaaagtacatattgaaaaggtagactacaatacggttttcttgtttaacttgatagtcagtattgttttatacatccttttatatgtagctgctcccgctatcagtctgttttttaaagaactggttttgatagatgtgttaagggtaatagggctgattctgattgttaatgcattgggtatcattccccgtaccatattagtaagaggtattgattttaagacacagaccaaagtatccataatctcttctgtttcaggtggattggttggcgtaggcatggctatagtgggctttggagtatggagtttggtgtggcaacagctttcccggcagattctgaattctctgtttctttggatattctgtaaatggatgccccaatgggaattctccgtaaaaagcttcaaggaaatgttcggttttggctataagctcttgttgtccggattattggatactctttacaagaatgtttattatgtggttataggccgttgttacagttctgcacagttggggcaatatactcgtgcagagcagttcaatacgatattttccagtaatctgaccagtattgtccagcgtgtcagttatccggtgcttagttccattcaagaagaaccggagcgcttgcgcgaagcttatcggcagataataaagactacaatgcttgtgacattcgcttgcatgctgggacttgcagctgtggctagacctttgattataattctgatcggtgagaaatggttgactgctgtttcctttctgcagatcatttgtttcagtggtatgctttatccgcttcatgccatcaatctgaatatcttgcaggtgaaaggacgttcggacttgtgtttgaagttagaaattataaaaaaaattatagctattggccctatagtagtcggcatcttttatggcatcgaatatatgctgtggggcagtgtcttaatctctttcatagcctatttcttaaatagccattattctgccgacttgatacactattctaccatggaacaaatcaaggacgtgtttccggtttttacagtttctttgatagtttctactgtcatgtggcttttttccttattggatatatccgtttatattcagttacccatccagattatagttggtttgacattggcttttgctgtttacgaaaggttaagattaccagagtatcttgaggtaaaacggcttgggttgtcggctcttcacaaaaaatagaaatcagtatatatttttatagtaaaatggaaaataaagtgattacagttacttctccattacttccttcgcttgacgatttcattccttatttgcaggatatctggaatcgtaagtggctgaccaataacggtcattatcatcaggaactggagaaagctttgtgtgaatatttgaaggtgccttatatcagtcttttcaccaacggcacactgccgttgatgtgtgctctgcaagcattacgaattaccggcgaagtaataaccactccatatagttttgtagctaccacccatgctttgtggtggaatggaatcaagccggtattcgtggatattgaccctgaaacttgtaacattgacccggacaaaatagaagcggcaataacccccaagacaacggcgattatgccggtacatgtttatggcaagccttgtgatacagagcgtatccaggcaatagcggacaaatacggtttgaaggtcatttatgatgctgcccatgcttttggggtagaggtgaatggaaagtcggtattgaatgccggagatatgtcgacgcttagttttcatgccactaaggtatataataccgtggagggcggagcattgatttgccacgatgaaaagaccaaaaagcgtattgattatctgaagaattttggttttgcaggagagacagagattgtggctcctggtattaatggtaagatggatgaagttcgtgcagcatttggcttgctcaacctgaagcaagtggatgttgcgatagaagcccgtcgtcaagtggctattcgttatcgtgatgctttgcgggaagtgcccggcatcagttttatggaagatatgcttggtgtacgtcacaactactcttattttccaatatttgtggatgccgagaaatatggcatgactcgggatgaactctattttaagatgaaggaacaaggtgtgctgggacggagatatttctatccgcttatcagcgagttctctacatataggggattggagtctgcaaaattggaaagccttccagtagctactaaaatggcaaaaagtgtaatctgcttgccaatgtattgtggattgtcgaatgaagatgttgaaagaattttaaatctgatattgaaatgaaattaggtataatgcaaccttattttatgccttatataggttatttccagctaattaaggctgttgataaatacgttgtatacgatgatgttaattatattaaaggagggtgggtgaatcgtaacaatatattggtaaatggtgaaaagaaaatgtttactatcactttgaagggggctagtgcctataaacatttcaatgaaatagagataggagatgattttcgtaaatttatgaaaacattggaattgaattactctaaagctcctttctatcatgaaacaatggaattgttgtataggataattatgtttccaaatagacagttggctctcttcttggctaatagttttaaagaaattttagattatctaaatattcagactgaaatattgctatcttcagatttacctaaagattgctctttaaaaggaaaggataaagttcttcatatttgtaagttactatcggcagatacttattataatgctataggtggaaaacaaatctataataaggaagactttatgcaaaatggtattaatttgaaatttgtagatacgataataaaaaggtatccccagcaatctaaagaatttgttccatatttatcaataatagatgtactaatgaataattctaaagaagaaacttgtatgttattagattcatttagtttacaatgatgtcaataggtggctattttgaactggaaatacgtgaaggaaaacattttcatcaaggtgcaataaaactgagtactgctcgtcaatgctttgagtatatattaaaagctagacggtatacaaaagtgtatattccatattacacttgtgatgtgataatagaacctctcatgaaattaaatgtaaagtatgaatattatcatataaatagtttactggatcctgtgtttgataaaaaaatagaaagctcagaggcttttctatatactaattatttcggcttaaaacaagatactgttctttatttatctcggttttatcctaacttaatagttgataatgcacaagctttttttgcaaaaccaattgaaggggtagatacattttattctgcccgtaaattttttggagttccagatggcgcttatttgtacacaactgcgttactggatattgatttcccgatttataatcctattgataatattaactacttgatagggcgtataactgactctgcagaggggtattataaagattttcaagaatctgaaaaaaggatgtcaaatcaagagatacatagaatgtctgtattgtctgataaaattttgtcttctttggattacgtctcaataattgaaaggcgtcgttttaattatcatcttctctacagtgcattaactgcatttaataaatttgattttagtatttctgaaaatcaaaatgtcccgttgatatatcctttttatacgagcaaagctgggcttcgccaacaattaatattagagcacgtatatgtacctcaatattggcaaaacgtagtgaataagatagacgctaaatgtctggaatactcaatcgcgaataatatgattgcattgcctatagatcagagatatgatgaaaaaacaatgaatatattaattgaaaaaatatctaacttaaataaccatttatcatgaaaaagaaaattattatttttggagcaaccggtaatacagggtcttatttgttagaatacgcattaaatttctttaataaggaagagtatgaaataatagcttcaggacgtcgcgaaactacttttttttccaaaaggggaataccatattattctgtggacattacgaaggaagaagattttgataagcttccaatggaaaatatacatgcagttatgctactctctgctcaaataccttcttatatggatacttattgccccataaagtatttagattctattgtaataggaggatttaatgtattagagtattgccgcaaatgtcatgtagataggataatttatactcaaaccgtttttgatatttcattgtattctcatgatactattttaaaacccgatatgaaaccaaattttagctatacgggtgatcatgctatatatgtaatttccaaaaatactgctttagacttgatagagcattattatcaagaatacggtttgaaaaaattcatttttaggcttccaacaatatatagctatagcccttatccgtactactttcctaatggagtcaagacgaagcgacctatttaccaaatgattgaaaatgctcagaaaggactacctatagagatatggggagatcctcattatgcaaaggatatggttcatgttaacgattttagtcaaatgttgtgtaaagctgttgaggtggaacaagaaagtggcttttataatgtgggtacaggaatgccaattacattagaagaacaaattcgcactattattagtgttttttcgcctaaggagtcaccatctgaagttatatatagaccagacaaagtttgtggtggtgggtacataatgaacattgaaaatgcaaagaaagaattaggatatgtgcctcaatatgattgtcgtaagttgtttgaggattataaaagtgaaatggaaataaagcgttttgctgaattaagattaaaataaatgaacggttcaatgacagttagcatatgttgcttgacgtataatcatgaaaaatatataaggcagtgtttagatggccttataatgcaaaaaacagaatttgattttgaaattcttgttcatgatgatgcgtcttctgatgctactcagagtattattaatgaatatgttgtggcatatcctaatcttattaaaccaattcttcagattcgaaaccagtattctcaaggtatttctccgttacgtcaaatattatttcctttagtaaaaggtaaatatgttgcgctttgtgagggggatgattattggactgatccgttgaagttacaaaagcaagtagattttttagaaaatcatccagattattctctttgttgtcatatggtaaggcgtattaatcaacagactggtgaggaacttaagtcagattatatatcatatgatatggatttgagtaataatgaaataattcttgcacacggctatttgacaccaacattatctcttgtttttcctaggttatatcttgataaaaggcctagctatttgaaaaaatctcctattggagatcttccacttactttttttttaatgattaatggaaaagttcattgcttttcttctatgatgggagtatatagggcttatgttcctatagcatggactgcttcttatgcaaaacgatcttttatgaaacgattccattttcgattaaaatataatgcatttattttggaatttaataaactgacatgtggtgagtattatgaggatttgaaaaatgagcatttgcaatatggcaataatttgaaaggtctttttgtatatatcttaagcaaattttatcactttatcacttattataattagtgtcatgagaaaaatagcgattatattgcctggagataaattacctttgccgtcagtaaaaggaggagccgtagaatctttggtacaatgtttattggattataatgagaaatatcacacttataattttgtcgttttttcagtttataatgaagaagctgctctcaagtctcgttcttataagcatacagattttaaatatatcaacactgactctttaaattataaattaaagcaagttttccgatggatatataatcgttttttcccttatattgggaatcaatttataaattctgtcatgaatggaatggatacagattatgattatgttcttattgaaaatgctccttggtttgttataccattgaaaagaaaaatgaatatgagtatggtacaacatttgcataataattatctgggaatcacatcttcatttaaccaacaaattatagataattctgattttgtattagctgtcagtaaatttattaaaaatgaaattctttctcatctcaattgtactccagaactcatttctgttttatataatggcatatccttagaaagatttggaaagtcagaatgtttatggtcattacgtgaacagcttggcattagtcatgatgactttgtatttgttttttcagggcgattagttccggaaaaaggaataaaagaattgttattagctataaagcaaattcaacatctcaattttaagttattaattataggtagttcttttttttcatctgatcgaaagacttcttttattgaagaattacagaacctatcgtctgaattgcctaatgtgatttttacaggatatataccttatcaaaaaattcaagattattatcatttggctaacgttgctatagttccatctattggggatgaggcatgtccattatcatgtattgagtttatggcttcttcacttccgcttattgttactgattcaggtggtatggttgaattggtcgatgaagattgtgctattataattaaacgcaatgaaaatattataacgcaattaaaagatgcaatgatcaatttgttaaataataaacgaaaatgccagttgatgggagaagctgcaagaaaacgaagtacgttattctctgatttggtttattctaagaagtttatggatcttattgataattaattaattaatgtggattttattatatcctttaacgttttgcatttgcctattatataacttgaaagggaaagggcttaatgcttcttcatttatacttttattatattttctatcttcaatctgtggtgtgtgtttacatctatatcatccagattatataaaaatagaaatttctttgcaagcagttgtccatcacctatcttgtctgtttttgattctttatcctatcttacaatacggaaatactttaagttttgatttactttataataaacaatctttcaagaggattgctataataataagcttattttctttattagggataatttctgatatacctaattattatttagccttttctcaacctttggctgcagttagagctatgaatgtagaaggaggactggttaatacgcaagttggattaaagtcgtatttgatagctattggccattcggctggtccattttgtcttttcttgtttttttattttaggacctttttaaaagtaaagtattatctactattactatttattgcatctttaacaaatttatcatctaatatactggctgctggtagaggagaaacttttcggtttatttatcaattcattttattctatttgattttaaaaccttatatgaaaacgttgagtaaacctatagtcttttctttttctgtagttataattggttttctttattttgtgtattccgttacagcaagtcgttttggttctgaaaatgtattattaaatatagctgattatttcggacaaggatttgtaaattactcaagattttatgattcatttcaagaaccaacattttggggcaggaagagtttttcaggcttatttccaacagagtatagagttgattcattggatgtgaattcagttataagaattggattttatttaaatgtattttctacatttataggcagttttttgtttgattttggaacttgtggaacccttatattctcatttattttattcagtattctttcttttttatttaatagtaagattagtaattttattaaattatttttttacatttattcttgtgatattgtaatgtttggtgttttctattataatttaagtaaatcaacggcgttactctctttgatagttttatttatgttagttgtattcttatattctaatgtgtttcattataaattcaaattgtaatgagtattttgttttggtattataaacctattatttcgactaacggtggcgtagagagggtgacagatgtattagctacatattttaaagataatgggtatagggtgttttttctttcttttgaaaagatgggtatgtgttccgattgtcactattttcttcctaattctgaagatttaatgtctgttgaaaatcttagatatgctgaaaacttgattttcaataaacgcatatctataataatcaatcagaatggattatcacctttattttcaaaatttatttttactttacatcttgataagattccagttaagataatatccgtaattcataattctcttttatctcctataaagaattatgcaatagtacattcatatccattgttgtttcaaaaaatattttctaatgttttttttcagtttttgcttttaaagttatactatttgaaatattcaaaacattttcaatatcttttcaagaaatcagaatgtactttattcctttcaccttcttatttgaatgaagctgttttttttcaaaaaaatattagtatgagtaaaataggctgtattcctaatcctgcatcttttattaatcaaggattgtttgaatccaaatcaaaggaggtcctttatgttggtcgcttagatttttctcaaaaaaagatagattacttattggatatatgggaaatagtttcttctgttaaaaaggattggtctttacgaattgtagggggaggtgacaataatagagcaaaagcgtatgctgataaacgtaatttaaataacattatttggtgtgatttttgtgatccaactatttattataaacatgcatctattttttgcttaacatcttcttatgaaggatttcctatggttctgattgaggctttgacgtatggagttgttcctatagcatttgctagttttgaggcacttcaagatataataaaagatggtattaacggatttgtaataactccttttgacaaaaagaaatatgctgataggttaatatggcttatggataataaggaagaactaatgaaaatgagccatgcaggtttttcttcttctttgtactattccttggaatcagttggaagtaaatggcttaaattatttaaaaatatttcataattagtatatggatttatatatatttcctgaattcccagaatcgcaaaatggctatggaattgcagtaagggaggtccttaatatgttgtcagttaaagaagatgatattgtagtttaccatacaaatactatattacgacagaaaaatgtgatttgtttaccttattcgcctctttatagtttgtataggattggtaatgttattcacaatagactttctacagagttaccagtttctaaactctcttttttgagaaaatatgatattgagaacatatattgtgatgaagtccttttttatagggctttaagatatttattccctagtaaagtgataaaggtaaggtttcacaatttatatagtcgaatcttaagtcgaaaaaaacttttggctttaaaagttgattggaaatttgattatttattagatgctgctacaaagttggaaaaagaaataataaatgattctttggcttacaaaatttttataagtcaagaggacttgaacttttatcagctaataactggccgtttttcagattgtaccgtatggccttttagacctaaacttccaaatatttctttggaacaaccaaagagtatttctaaactaatatggtttggtggtattgatacgcataaaaaaaaatctatagattggtttgttaataaggtgttacctaaaatacaacaatctatttctgagattgaatttcatttatgggggagaagaacagaaatgtataataatccttctcggaaaatattcggacatggcttttgggtaatggaggggttcccttgtgtggaaggtgctctttatgttaatccagatattattggaggaggggtaaaattgaaattattttctcttatagaagaaggtattccatttgtttctactgtttttggttttgaaggatatgataaaaaaatgatagataattctatgcgtattgtaacggacaccgagcattttgcagaggctattatttcacgtttgcagatgggatattataacaatgtataagtgagaatgtgtaatctttcatttttgagaataatcatataaataattatgtccatattcaaagacaaagtcctccttataaccggaggcaccggttccttcggtaatgccgtattacgtcgttttcttgattcagacatcaaggaaatccgcatctttagtcgtgacgagaaaaagcaggatgacatgcgtcatcacctgcaaaatcccaaggtaaagttctacataggtaatgtgcgtgaccgtcagtctgtggacggtgcaatgatgggagtggattatgtgttttctgccgctgctttgaagcaggttcccagctgcgagttctttccgttgcaggctgtgcagaccaatgtgatcggtacggataatgtactggaatccgccatagcgcatggtgtagagaatgtggtggtgctttctaccgacaaggccgcctatcccatcaatgccatgggtatcagcaaggccatgatggagaaggttgccatagccaagggccgtgcgttgggtgaggaagccggtacgaccatctgctgtacccgttacggcaatgtgatggcaagccgcggttctgtaattcccttgtgggtggagcagataaagaacggcaggcccattacggtaacagaccccaacatgacccgcttcatgatgacgctggacgatgccgtggatctggtaatctatgcgtttgagcacgggcataacggtgacctgttcgtgcagaaggctcctgccgccaccttggatgtactggcgcaggccttgaaggaaacatacgcgcaggttgatccgaaatacggtgagacggaggtgaagaccatcggcacgcgccacggcgagaaactgtatgagacactggtaacccgcgaagagatggcaaaggctgtcgacatgggcgactactaccgcatcccctgcgacacccgtgacctgaactatgacaagttcttcacggaaggcaatgaggatattgcccgtatagaggactatcacagccataacaccgcccgcctggatgtggagggcatgaaaaagcttcttttgaaactccgcttcatccgcgaagacctcggaatggaggaaaaggcgaagagcgcggaaatcaagagtgaatagtatagccattgttaacttttccatcctatccaatcccattagtttatgaaaatcttagtgaccggcgcccgagggtttgtcggccggaaccttgtatcccagctgcacaacatccgtgacgggaaagcccgtaattacggcattgcaggtgaggaacttactatttacgagtatgacatggacagtgaccctgccgaactggatgtctattgcagacaagctgactttgtcttcaatctggcaggcgtgaaccgtcccaaggatgcgtctgagtttatgaaagggaacttcggcttcgcctccacgctgcttgatacattgaagaagtacggcaatacctgtccggtaatgatttcctcttccacgcaggccgcactcgacaacccttacggtgaatcgaaacgggcaggggagcaactgttgttcgagtactccagggaaacgggtgcaaaggtactggtgtaccgcttcccgaatgttttcggcaaatggtgccgccccaactataacagcgcggtggccactttctgcaacaacatcgcccatgacttgcccatccgggtgaacgacccttcggtggtgatgcatctggtttacatagacgatgtggtggacgagcttatctctgccctgagcggcatggaacaccgcaacggggattattgcgaagtacccgtagtacataccattaccttgggcggcattgtggaactgataaggtctttcaggcaaatgcccggtaccttgtccgtcccggatttgagcgatgcctttacaaagaaactctattccacatacctctcatacctgcctgaagaacggttcagctatcccctgaagatgaatgtggacgaccgcggcagttttacagagattatccgtacttccgactgcgggcagttctcggtgaacatctccaagccgggcgttacgaaaggccagcactggcaccataccaagaacgagaagtttgtggtggtgagcggacacggtctgatacagctccgcaagataggtacggaggaggttgtcagcttcgaggtaagcggcgggaggatggaggtcgtggagatgattcccggctatacgcacaacattgtcaacctttcggaaacggaagacctggtgactttcatgtggtgcaacgagtgtttcgacccggcacgtccggacacttattttgaaaaagtctgaaacgagttaaagaatataggaacagatggatataaaattggattattcgcaagtcaggtttcaggagaacggcagactgaaacttctgattatagtgggcacccgtccggaaatcatccgcctggcggctgtcatcaacaaatgccgcagttattttgactgtcttctggcccacaccggccagaattacgactataacctgaacggtgtcttcttccgtgacctgaagctgaaagaccccgatgtgtatatggatgccgtcggcgatgacctcggtgccacgatggggaatattatcaacgccggctacaagctgatggtgcaggtgaaacctgatgccgtgctggtgttgggagacacgaactcctgcctgagcgtgataggtgcgaaacgtctgcatatccccatcttccatatggaggcaggcaaccgctgctttgacgagtgcctgcctgaggagaccaaccgccgtattgtggacgtcatttccgatgtgaacctctgctattcggagcatgcccgcagatacctgaacgcttcgggcgtggcgaaagaacgtacatacgtaaccggttcgcccatggcggaagtcctgcatgagaatttatccgaaatagagtccagcgatattcatcagagattgcatctccagaaaggtaaatacatcctgctttccgcgcatcgggaagagaacattgacacggagaagaacttcctgtctcttttcagcgcggttaacgctatggccgagaaatatgacatgcccatactttacagttgtcatcctcgtagcaggaaacgtctggaatcaagcggctttgcacttgacagacgtgtgattcagcatgaacctctcggtttccacgactacaactgcctgcagatgaacgcctatgccgttgtgagtgacagcggtaccctgcctgaggagagcagtttcttcacttctgtggggcatcctttccctgctgtatgcatccgtaccagtacggagcgtcccgaggctcttgacaagggtatctttgtccttgccggcattgatggcaaatccttgcttcaggctgtagatactgccgtggagatgaataggaatggggatcacggtctgccggtgcccaattatacggatgagaatgtatcggccaaggtcgtgaagataattcagagctatacgggggtggtgaacaagatggtttggagaaaattctgaaaacgcaatgtcttctaaaagagtgtgggttgtttctgaaatatattatccagtaaaaacttctacgggatattacatgactgaaatagccgaatatctggcagctagagctatggacgtgcatgtgttatgtactgggtctgtatataataatggcgaaaagcggtcacgcttgaatgaggaatcacgcaatggagtaaaggttcatagggtatatgtacccaatattgataagaacaacttcgtaaaaagaactcttaggttgtcgttgtccagtttgttgctgttcggcaaaatactaaagctggtaaggaatggagatgaggtcctggtggtaaccaatcctgcttttctaatactgatgatgccacttgttgcatggataaaaggcgtttcatataagattctcgtacatgatatatttcctgaaaatttggtggccataaagcgtctgtcttcttcctccttcatttacaaaagtctgaaaagggtatttgatgccgcttattctaaagctgtactttgtatttcgataggcagggatatgagtgaggtgttgaaaaaaaaaataggggatgcttccaaaatctgttttatacctatttgggctgagaatggagtggtctttcctatggataaagcaggtacccggatttgttcatccttgaggttgcaggacagatttgtatttcagtttgcagggaatttgggctatgcccaaggtatagataatctgctggaagctataggactcattaaaaatgataacattcatttcctattcataggtgatggtgccaaggctggtgacatagtgtcatatatgaaaaaagggacacataagaatgtatccttgttgggtttccaggatcgtgcgaatcagaatgatttcttgaatgcttgtgatattggcattgtgactttatctgatgggatgtacggtttgggggttccttccaaatcatataatataatggcaagcggcaagcctatgctatttatcggtgacagacagtcggagattgctttatgcattgaagaatattcgttgggctgggttgtagagccggataatcctaaaatgctggcccgtatgatagagcatatctattctaataggacatgtctgtccgcaatgcaaaacaatgcgaaaacggtggcggatactgtttttgcaaaagaacggatactggaaaagtattatagactgttgagctaagataacctattcattttatgaagcttttatttaccggagcctcaggttttttgggtaatggcatacgttcccttttggatagaatgtatactgttgcaactgtaggactgctatcgcagaatgactatactgtaaatatagccaatgagattcctgaattacatgaacggtatgatattatactccatgctgcaggaaaagcccattctgtgcccagaagtgaagccgagaaacagatgttttttgatgtgaatttacagggtacaaagaatctctgtgctgcattggaaaaagttggagtaccgagagtatttatttttatttccacggtggcagtttacggttgtgcttatggcgagaatattacggaagaccatcctttgaatggagacacaccatacgccatgagtaagcgtcttgcggaggaatatctgcaaaagtggtgttacgaacataatgtcattttaggcataatccgtccttccttgattgccggtcccaaccctccgggaaatctgggggctatgatttatggtatccgcagtgggaaatacctcagtattgctggcagtcaggcacgaaagagtgtattgatggtgcaggatattgcaaaattagttcctctgttggcagaaaagggaggcatctacaatgtatgtgacagtcatcacccgactttcagagaacttgagactactatttgcaggcaactggataagaaattgcctttatcaataccgtactgggtggctaaatgcatggctttggcaggtgattgcttgggaaggaaagctccaatcaattccttgaagttagataagattacgaaatccttgactttcagtaatgaaaaggcgatacgtgaattgggatggaagccgaccaatgtgttggaaaacttcaatatagaatgaatgtatatttaggtgtcttattgatagggctgggtattgtatctttaggatttacatgtattcagctctggttttactggataatcaaaaacggatgatgtattatttaatggttttggttctgctgtttttggcagaacttttttattttagagtggctgataggtacagcagaggatgaaatatttcacgggagggctgacatacaaaattcatttgaaataattaatgaaaaaatcagcggagggatgtttgatactatcagacatcccttttttctgtattatatatgtaagattaacggcggaattcaaattttaatcgtaattttgtagcccattatgagtagaataatagccatagactacggtcgaaaacgtacgggaatagccgtgagtgatacattgcagatgattgcgaatggactgacaactgtgcctacacaccaattgttgcagtttcttcttgattatgtggctaaggagccggtagagcgtatcttggtaggccttcctaagcagatgaataatgaggcttcggaaaacatgaagaatatcgaaccttttgtccgttcgctgaagaagaaactgcctgacatgccggttgaatatgtagacgagcgttttacttctgttctggctcatcggacgatgcttgaggctggattgaaaaagaaagaccgccaaaataaagcactggtggatgaaatcagtgcaactattattctgcaaacttatttggagaacaaacgtttctcctttttataatgtatagaaaataatttgtaattagtaatttgtagtaaaggaaatgattttacccatttatgtgtacggtcagcccgtattgagaaaggtagcagaggatattgccccggactatccgaatttgaaagagcttattgagaatatgtttgaaacgatggaccatgccgaaggcgtaggacttgcagcaccgcagattgggcttcccatccgcgtggtggtaatcgatttggatgtactttccgaagatatgccagaatataaagatttccgcaaggcgtatatcaatgcccatattttggaggtgtccggtgaggaggtttctatggacgaggggtgcttgagccttcccggtattcatgagtcggtgaagcgtggcaacaaaatacgtgtgcagtacctggacgagaatctggaaccgcacgatgagattatcgaaggctacctggcacgcgtgatgcagcacgagttcgaccatctggaaggaaagatgttcatcgaccatttgtctccgttgcgcaagcagatgattaaaggaaaactgaatgccatgttgaagggcaaggcacactgcacttataaggtgaaaaccgtaaagaaataagtcaaccatataatatggtataaaaggctcaaaaaatataaaaagtgttccgctaatcccgacaagtaaacgaaaaacgttacttttgtttcgtttacaagcatttataaaacaagatgataagaaaaatactgacagctattttgctgttacccacattgttgtatgcgcaaatcaatacggaacgggtgatgaccattgctcggaatgcattgtattttgaggattacgtgctttctatccaatattttaatcaggtaatcaacgcgaaaccttatttatatgagccttatttcttccgtggactggcaaaaatcaatttggatgactatcagggagcggagagtgattgtgatgctgcgattcaaagaaatccttttgtggtaggtgcttaccagatcagaggattggcacgtatccgtcagaacaagtttgacgaggcgattgaagattataaaaccgctatcaaatacgatccggagaatgtggtgctttggcataatctttctctttgccatattcagaaagaagattatgaggcagctaaggaagatttgggtacgcttctgacaattgcccccaaatatacgcgtgcctatctgatgcgcggggaagtctccctgaaacagaacgatacgatacaagctttgcgtgattttgacaaagctattgatatggaccgttatgacccggacggatggggggcaagagccattgtacgtctccagcagggaaagtataaagaggctgaagctgatttggaccagtctatccatctgagtgcaaagaatgccggtaactatatcaaccgtgccttggcgcgtttccatcagaataatttgagaggcgccatgagtgactatgatttggctttggatattgatccgaataattttctcgggcactacaaccgcggtctgctgcgtgcccaggtaggcgatgacaaccgggcgatagaagattttgattttgtgttgaagatggaaccggataatatgatggccactttcaatcgtggtttgttacgtgcgcagacgggggattaccggggagctatcagtgactattccaaagtgattgcagaatatcctaactttatggccggctattatcagcgtgccgaagcccgtaaaaagattggcgaccgtaaaggagccgagcaggatgagttcaaaatcatgaagatgcagatagacaagcgtaacggtgtttcttccggtgacaaaaaggaaggtggcgacagtaaggatgttgcggataattcttcggggaactccaatggagatggcgggaagacccgtaagaaatccgacaagaatatggaaaattatcggaaaattgtaatagcggacgattcggaagttgaccagcgttataagagcgattatcgtggacgtgtacaagaccggaatgtgaccatcaagcttgagccgatgtatgctttgacttattatgagaaactgagcgatgtgaagcgtatcgtacattatcataagtatattgaggaactgaaccattcgaaactgttcccgaagccactgcgcatcaccaatatggaagctccgctgacggaggaacaagtacgcttccactttgctttgatagacgctcatacgtctgatgtggtggctgacgagaagaacgccaagaaacgtttcatgagaggtctggacttctatctggttcaggattttgccagttccatagatgactttacaaagagtatcttgttggacgacactttctttccggcatactttatgcgtgctttggtgcgttataagcaactggaatataaaaaggccgaagccacaatgagtgaaggcgccacttcgggtacaacggaaatgaagaagcctgaagtgacggccatcgattatgaagttgtgaagaatgacctggaccacgttatccaattggctcctgattttgtttatggctattataaccgtggcaatgtgtcttcgttgctgaaggattaccgtgccgccttggcggattatgacaaggcgattgagctgagccccgattttgctgaagcatactttaaccgtgggttgacgcacatcttcctggggaataacaaacaaggtattgctgatttgagtaaagccggagagttgggcattgtgtcggcctataatatcataaagaggtttacagatacacgggaataacatttttttgctaaaaaatagaatatcaaaaagaattagctatttttgcgttctgaaaaatgaaatatacatataaactatgataaagataacatttccagacggctctgttcgtgaatataacgaaggagtaacgggactgcagattgcagaaagcatcagttcgcgattggcacaagacgtgctggcttgtggcgtgaacggagaaatttatgatttggggcgtcctatcatgcaagacgctgaagtggttctttataaatgggaggatgagcagggtaagcatgccttttggcataccagtgcccacctgctggccgaagctttgcaggaactctatccgggcatccagttcggtataggtcctgctatcgaaaacggtttctactatgatgtggacccgggtgaaacgactatcaaggaagctgacctgccggccattgagaaaaaaatggctgaactggtggctaagaaagaagcggttgtcagacaagacattgccaaggcagatgctttgaagatgtttggtgaccgtggagaaacttataaatgcgagctgatttccgaattggaagacggtcacatcacaacttatacgcagggtgcatttaccgacttgtgccgtggccctcacttgatgaccacagctcctatcaaggctattaaactgacttccgttgccggtgcttactggcgtggacaagaagaccgtaagatgatgacccgtatctatggcatcactttccctaagaagaagatgctggatgagtatcttgttctgctggaagaggcaaagaagcgcgatcaccgtaaaatcggtaaggagatggacttgttcatgttctccgacaccgtaggtaagggactcccgatgtggctgcccaaaggtactgcactgcgtatccgcttgcaggacttcttacgtcgcatccaggcccgttacgattatcaggaagtaatgtgtccgcccatcggcaacaaattgctttacatcacttccggacactatgcaaaatatggtaaggactcctttcagcccatacatacaccggaagaaggggaagagtacttcttgaaaccgatgaactgccctcaccactgtatgatttacaagaactcaccccgttcttacaaagacctgcctttgcgtttggcagagttcggtacggtttgccgttacgagcagagtggtgagctgcacgggctgacacgtgtacgtagctttacgcaggatgatgcgcacatcttctgtcgtccggaccaggtgaaggatgagttcctccgtgtaatggacattatctccatcgtgttcgaatctatggacttcgagaacttcgaggcacagatttccttgcgcgacaaggtgaaccgcgaaaaatatatcggtagtgacgagaactgggaaaaagcagaacgtgccattatcgaagcttgtgaagaaaaggggttgaaggcaaaaatagaatatggagaagctgctttctatggtcctaaactggatttcatggtgaaggatgccattggtcgccgttggcagctgggtaccatccaggtggactacaacctgccggaacgtttccaactggaatataccggtgccgacaatcagaagcaccgtcccgtaatggttcaccgtgctccgttcggctccatggaacgtttcgtggctgtgcttattgagcatacagctggtaaattcccgttgtggctgactcctgatcaggtcgctattctgcctatcagcgagaagttcaacgactatgcgcatgaagtgaaacaatacttgaagcgatatgacatccgtgccattgtggatgaacgcaatgaaaagattggtcgtaagattcgtgacaatgagatgaagcgtattccgtacatgctggttgtaggtgaaaaggaggctgaaaacaaggaagttgctgtccgcaagcagggagaaggtgataagggaaccatgaaatttgaagaatttgccaaaaaaatgaacgaagaagttcagaatatgataaataaatggtaactttgcgcccaattgtagaagcatagcatatattagatgttctaaagatcgcttttacttaacataaaacattaatttgggaatagtaaataagaaacaaactggaagtaaacgttatttaatgaagaatgacagcttaaaagggcaacatcggattaacgaacaaatccgggccaaagaagtccgcatagtgggcgatgaagtagaaccaaaagtgtatccgatagcgcaggctttaagacttgctgaagaacatgaagcggatctcgtggagatttctccaaatgcacaaccccctgtttgtcgtattattgattattctaaatttctttatcagttaaagaagcgtcagaaagagcaaaaggcaaagcaggtgaaggtaaacgtgaaggaaatacgttttggacctcagactgatgaccatgactataatttcaagttgaagcatgccaaaggctttttggaagatggcgataaggtgaaagcctacgtattctttaaaggtcgttctatcttgttcaaagagcaaggagaagtgctgctgctccgttttgccaatgacttggaagattatgcgaaggtagaccagatgccggttctggaaggaaagagaatgacaatccagctctctccgaagaaagcggcggcatcgaagaagagcgtggctcccaagcctgcagaagatgcgccaaaggccgcgtcggctgaaaccgaaggagaataaagaatgagtaacgccataggtatagtgcgttgccatataatttaataattaaaaagttaaaaaagatgccaaagatgaagactaactccggttctaaaaagagatttactcttaccggaacaggtaaaatcaaaagaaagcacgcttttcatagtcacatcctgactaagaaaactaagaagcagaaaagaaacttgtgctactctacacttgtaagtacaacagatgtaagccaggtgaaagagcttttagcaatgaagtaattgaaaagcgtacaaaagtattaaagttattaaccgaatgcattagctttaagtccgctgcgtgaagtaacggcgctaacattcaaaaacaagtaaaactatgccaagatcagtaaatcatgttgcttctaaagcaagaagaaagaaaattttgaaattgaccagaggttactttggtgcaagaaagaacgtttggaccgttgccaagaatacttgggagaaaggtttgacttatgcgttccgtgaccgtaagaacaagaagagaaacttccgcgctttgtggattcagcgtatcaatgctgccgctcgtctggaaggtatgtcttactctaagctgatgggcgctttgcacaaagccggtatcgaaatcaaccgcaaggtgttggctgatttagcgatgaaccatccggaagctttcaaggctatcgttgctaaagcaaaggctgcataaaaacagttagcagataaattacgaggtgctgattactcttttggtagtcagcactttttgttttctgatagtcttgggaggggttaaaacattaaaaggacttgaaacaatttgctgattttacttgtttctttcatagaaactcattacctttgttatagaaaaaatagccgcattgattggatcgggaaactcatcaatttttatgaaataccgagacaagcttcgcttctcaatggcgggccacgcccttcggggtaactcttgagtcggtggattacaaagaggaggagcactcaaatcatgtcatacggagtttcatcacatcatcggtgcggctttctataaaagaggaacggtaatctgtctggataaccgttcctctttctttttatgcggatgtgggtgattgtgaaacaaatgatacgtgatgctgaaacagatgatgtatcaagggaagatagatgatacgtttatacaaaacagaccatctgtatcgggtgaacagatggtctgttttgaaaagaggtttttacggtttatttgttgttcctcaggtcttttaccctgacggcttttccttcgctctgcggtagggagcctttcttcaccaaccgcaatttcggggttaccagaatctcgtctttcaactgacgggtgattgctttgcgaatcttctccagctcgatatagttatcggtagagaggtcgctgagttcaacttctacaatcatttcatcttgattattaaccgtttcaagtgtgatgaggtaattactgcccaattcggggaattgtaccagcaccttttccacctgcatggggaagatgttgactcccttgatgatgaacatgtcgtcactacggcctttgatgcggtctatacggatgtgggtacgtccgcaagggcacttgccaggcagaatgcgggtaaggtcgcgcgtgcgataacggataagcggcatcatttctctgtctaaggttgtcagtaccagttcgccgatttcaccttccggtacggggtcgccggtttccggattaatgatttcgaccaggtagcaatcttcccagaagtgcatgccgtcttgttcggtacattcgaaggctacgccgggaccgttcatttcagtcataccgaagctgttgtaggctttgacaccaagcatgcgctcaatctttctacgttgctcgtctgtgtggggttcggcaccgataacaagcgttttcaagcttgtactggtagggtctataccttcttcctggaatacttcggccagacggatggcatagctgggaatggcatgtagggcagtagtcttgaaatcggtgatgaacttaatctggcgcttgctgttgccggcagcggcaggaacagtcagtgcacccagacgttcggctccatactgaaagcccagtcctccggtgaacataccgtagccggagctgttttggaaaacatccgtcttacggatgcctaccatatagaggcagcgtgccactaagtttgcccaagagtccaaatcgtgttgggagtgtacgatgaccgtcggcgtgcccgtagtgccactggaagaatggatacgtactccgtcctcacgcatatcgcctgctactaatccaaaaggataattggcgcgcatatcagccttggtggtaaacggtatcttacgtatgtcttctatagaccggatgctgccggcagtgatgccatgctcttggaatacttttttatagtagggagagttggcggcaatgctgacagtcttttttaaccgttgcagttgtagttcgcgcaactgctcacggggcatcgtttcaatctcttcttcccagtatttgttattcatggtatgttgaaatttagagtcaattatagtttacatcagtttttcagcaatctctttgccggcagccaacgctttgaggttcaactctacaatggcgtctcccttgcgttggaagatttcgcggatgctgtcttgcacctttgcatagtcaatgccgagaaaggggatggtggcgcccagcagtacgatgttcgctacgcggggagagccgacttcttttgccacctcgtttacgttcagcatgattttatgcggcagcttgttgatttcggccttgatgtcttcttctgccggatagttgggaatgttgatgaagggagcttcattggtcaccagccaaccctcagggctgaggaaggggaggtagcgcaacgcctccatcggttccaaggagatgatgaggtcgcattttcctgtggggataaggtccgaggcgatgggttggtcgctgatgcgcaagttggactgcacgtcaccgcctcgctggctcatgccgtgtacttctgcctgcttcatgtagagtccgcccttgagggctgctttgccgattacggtggcgatggagaggataccttgtcctcctacgccggaaagtatgatgtcttttttcatggctttacttgtttctttttttgcgtgctaatgtttggatacattctctgcgggggatgatgacggatacgccgtggtattcgatttcttcccggatgatttgcttcatctcttcgtagttcttcttcaaaggaactacgacgcggatgtgttcgggagctacaccgatgccggcgcagatggcttccaaacgtccggtgccggcagagtcttgtcctccggtcatggcggtggtttcgttgtcggagatgacgatggtgacgtcggcgttttcgttgacgcaatccagcagtcctgtcatgcccgagtgggtgaaggtggagtcgccgataacggctacggcaggatgcagatcggcatccgaagcacccttcgccatggtgatggaggcgcccatatccacgcaagagttaatggcgttgaacggagcgttggctcccagcgtgtagcaaccaatgtcgctgaacaccttataagtgggatattcttctttcaatacttgggtcagcaccgtgtacatgtcgcgatggccgcaaccctcgcacaaagcgggcgggcgcatctctaccagagaaggaacgctgaattcagccttgttctctttgcctacggcatgtgccacgctgtccgggttcagctctccgtcttgtgaaagagtgccgtccaaacggccttttactttgatgccgatgcccagatagcctttcagctgtttttctacgaacggttgtccgtcttccagtaccagaatctcgtcacatgcttctaccagctgcatcagctgtttcttgggcaacgggtattgtccgattttcagtaccggatattcgcagccttcgggatagttttccatcaggtagttgtagccgatgccgcatgccacgatacccagctttttgttgggaccgtcggtatatttgttgtaagcggagttttcagaagctttgataaattcgtcctggcgttgcagcaatgctttgtaacgtttgcgtgcattacccggcaggaggatgaactgacgtgggtcttcgctgaaggaaatttcattctgcggttgttgctccttgcgctctacaccggaacgggagtgtgccaggcgcgtaaccatgcgcatcaggatgggttcgccggtctgttcggagaagctgaatccgttgtataccatgtcgtatgcttcctgctggttgcttggttcgtacatcgggatgagggagaagtcgccatagaaacggctgtcctgctcgttctgcgaggaatgcatgctgggatcgtcggcagctatgactatcagaccaccttttacgccggtaatggcagagttgatgaaacagtcggcagccacgttcatacccacgtgcttcatgcacactagtgaacgcttgcctgcaaaggacatgcccagggcagcctccatcgcagttttttcgttagagcaccagcggttatgaatgttcttttcagcagtaaccggtgtcatctgaatatattcggtgatttccgtagaaggagtgccgggataggcatatacgcccgaaagtccggcatctaatgcagcttgtgcaatggcttcatcgccaagtaagagttgcttgctcatatctgaatatttaagtgttagtcatggattaatatttgacgcaaatataggattttgcttttattttatcagcagattacttgaaaatctttctttcgtttaatgcatcccaatatcttcttgcatttttcatgtgctcggcataattggatgcaaagttatgggtgcccgagaagtcctctttggcacacatgtagaggtagttgtgtttcgtataattcagcacggcatccagcccgctgggtgaggggatgcgtatggggccgggaggcaatccggtattgaggtaggtgttgtagggggattctatcgccagatggccattcgtaattctccgcaagccgaaggcctgcaaggcaaatttgatggtagggtcggcttgcaggggcatgccggcgtgcaggcggttgatatataaccctgctaccatcggtttttcaggattgttgtttgtctcttcctcgacgatggaggcaagggtgcagatttccgtcggggtcattccgatggcggtggcttttcctaggcgttcctggttccagaacctttggtgctctttctgcattctttcgaagaactcttccacactcatgtcccaatagacttggtaggtttcggggatgaagaggcagggcaaggtctctttggtgtatcccagtttttgttggaatgcggagtcgttcatcagtccggctatttcggcggagtctatcatgagctgtttgcttatgctgcgtgccaggcggtccagcgtgcgtacgctgccgacggtgaggttcataggttcttgatatccgcggtacagacggctgaatacgtgatatacgttttctcccggccggatagcgtagcgtccggtgtgtatgttttcggaatatttcttgtattgggccatccagcggaagccggtgaagcttcggggatggccttgttgtttcaccttattatatatggagtcggcggtgtcgtcgcggtctatatagatatagactgtcttttgcggatggaattgcggggcaaacagatagtagtatactgttcctgcacaagctgctccaataagaattagtgtaacgaatgttccgataatgattttcttctttttcttttccattttgttttactgcatctttagtcgggcaaagttagtaaaaaatggagtgaaaatcatcaagtcatatcagttaattcgatagctgacaaaggctatgcgtttgctgtccggtgcccatgagttgacattgatggtgccttgtccgccgaaaatctttaacaaagttttgggttctccaccgtttgcgggcattaggcgcagttctacgttcttgtttgccagatgctctcccggttccaggtcacctttgtagtaggtgatgaatacaacggattttccgtcaggagagatgtgggggaaccaggagttgcgggtttcgtcaaaggtcatctgggtctgttcggagccgtctgccttcatgcgccagacttgcatgagtccggtgcgtacggagttgaaccagatgtattgtccgcagggggaatattccggtccatcatccagaccctcggcagtggtcaggcgggtttcttcacctccttccacggggatggtataaatatcatagttgccgtttcgttcggcgcaataggcaagttctttaccgtcgggactccaaccgtggaggtagctgggagccataggcgttattaaacggggagtgccgcccgtgatgggaagtgtataaatgcgcgatttatagtcctctttcgtcccgtggctgatggctatctgctgtccgtcggccgagaggacgtggtcgttgttgcagttttgggcaaatccggtgtttatcagttccggttcggcaggcgaggtgggggaaaggcggtaaagctttccttcgctgttgtatagcagccattgcccgtcgggcgtccaattgggggcttcaatccggtagggaaattctttgacgacggtccggttaccattggttacatccagtatttcgaggacgctggtaatctcgtttttttgttgagcggttgcggtcagtgcaacagttgcaaagaaggggattaaatagggtttcatgtttatatcgtatttaataaatctccgcaagatacattttttattggaaactacatagtcggagcatttttttcattaaaatctgtagtgctgaccgaatgcgtagtgcttatcatataaataattattgcaatgaatatttttgagggctacggtagattatgcttttcaaaatctctcaaatatccattcatctaccttcagttctttgcctttaaatacgaaataaaggttgtgaataccgtctttgtctgtgtttatctttgtagagacagtctgtaaagagtctgaattgaaggaggtggaagccagtacttcaccatcggggcggtcaaggtgcacttccagagtgccgtgtcctgctgctgtggcacggaatagagagggaaagccggagaagaatacgccacgtacggatataactgatttcttttgttcactgcccactgcaagcatgttgccgggtgtggctgtaggctcaaagtgtatgcctagcgtagcggctgttgtttctgcttgctgatgaatgaacgggttcactggctttatctggtccacacccttcagtgtggcttctcccatttccagcttcacgtttttttcgtctaccttcagcttgttgacgcaaaggctgcggaaaccgccattggtgcctttgtgttcttgcaagcacatgttgtgataaaataggtaatagtctcctttgtatttttgcagatgggtatgattgttgctgaaccccataccatagtctccgggattcttgaaataattgtccacatacttccagctgtcggtgtcgagaggcgtgtgtgaagtcatgtacgacatgcagcagatgctgggtttgtccactccctcgtggggccattcggtgcgcttgttccagtcggtattgtaggtataaatccatgtgccgttccagtagttcagctcattggcttcgaagtgatagggagcttttatctctactatctcgctgtccagactaatcaggtctttgcccaagcggacaatgcgggcatctccaggcatgtagtcggtgccgacttccccctttccgcctccaccgaatgataaccatcctataccttcgtcatctatcacggcacccgggtcgaagggagctttgcagtggcctaatccttgggtgaactggctcaccagcatacgccccagcgggtcggtccacgggcctacgggagaggtggaggttagtacgcctacgcccgcaccgctgttggagtagtagaggtagaagtgggttttaccgtccgattctatccgcgatacaatggatggagcccatgaggctataccccatggtgagagggcctttacgtcaatcagtccgtgataagtccagtttaccatgtcatcggtagacaacataaccagcgaatggatgtattggtatgtgtttttgccatctttccccacactgtccagttgctgggtgtcattggttccatacacatagagccttccgttgtattccatcgatgtcgggtcggccacaaaaatgaaatccgacagtgggttggcgtttccactgaagaatttgggtgattctaccggatgcgtgtctttctttcctgaagtggaaagcgcccacatatcgtttcctgcggacatagccgccagcagcaaagctgctgtaaataacttgattcttttcattttcttatagtatattatagaaatctatggtaaccttttgattttagcttgtgttttttcgtcatctcaatacttcatttaagattgaaaaatttggttattgaaaagttgccacaaatattgggaattactatatataatataggtgtattatgtttttaatagtgtatctatatgtttcaagttatcattttagactgtggatgtaatcagatggtgctgttttaaacctattttgagataatcatgcggctatagattaaactgtttgaaagggcattgtgttttatgcaaatatactcgtagaagagcgttttttattttagaaaagaaaaagcactgattatctggaataatcagtgctttaatattgagccgctagccagacttgaactggcgacctacgcgttacgaatgcgttgctctaccaactgagctatagcggcaataaacttttgtttacggggtgcaaaggtacatctttatttgaaaaggcaaaaagaatccttgttttttttagaaatattttagtagaataattttctgtttgaatgttctgaactttattgccttaaaaattggataataaaacgaaaagaagcatctttgtcgtaggtcctatagcaaaaagtctgatactgattatgaattttagaacatattataaatatctttcttcacgcatagcgtccaaatgggtggtgttgtcggtagatgtaattatcgttgtgatttccatactttctgcatgttttttgcaatataggctttcgtccgtatcttatgaaatttctttgtatgtatggctgaccatttgggctgtattgtgtaatgtctgtttctttcatattttccgtacttatgtaggtgtcatccgtttttcttcttttgtagatatttatcgtgtgttttggagccttacgataagctatgttgtactgtttttggggaatttctgttggtctgttttggggcttgaagaaactttgccgaacagcattctgtttatggcatatatgtttactttctctctgatggtttgtatgcgcattgctgtgaagatgctttatgaagctattgcttttgatgcacgtcattgcgtgaatgtttttatttatggattccatgggactggagtcgatgttgcaaaatccttgagagttagtcgtaataatcattatcgcctgcgtggctttatttcggacgaacttgatatgataggtaaacatacgatgggatgcagggtatatcccaacgatgaacagctgtttgatcgtctaaagaaaaagaaagtggatacaatcattatctctccaagcaaggtatcggatttggaaaattccggaatgctggataaactgttctctcatgatattcatgtaatgaccgttcctcccttaagcgattgtatggatgatggactgataaaggacattcaaatagaagattggcttcgtggagaaccggtacaagttgacatgcgtaaaattgcggcccatattgaggggcgtagagtaatggttacgggagcagcgggagctgtaggaagggaaatcgtccgccagttggctacactgaatccttatcagttgattctggtagatcaggcagagtccccattgtatgatgtacagttggaattgtctgatcattggaagaatctggaggtccgcgtattggttgcagatgttgctaaccgtacgcgtatggaggctatatttgaaggaacacgtcctcaacttgtttttcattctgctgcttataaacatgtacaactgatggatgattttgtgtcagaggcaattcaaacgaatatatcgggaacagtgaatattgcggacctggcggtaaagtatagagtgtcccgtatggttatgatgtctgtaactaatgcacgtcatccggagaatgctatggaatatagtaagcgtgtggcggaaatgtatgtgcagtcatcttattgcaggttgaaacgcgacaaaggggaaactgatatgttcatagtacgtttgggtgagatgtatccgatgaatgcgcattgtttgatgaccttgtctgaagcttgtatgctcaccctggaagtgggagtcatgggggatggaggagaagtgtacattgtaggagggcctggggatgggcttttggattctgtaatcagtgaaaagataaagcgtgaaaaggcatctgttgatgattatgaacatgtgcgggaagaagtgctggccttggtgcaacatagttataccgaaaaaaaggctattttgattggactaatgaaaaaaatagtgccaattttctcactttcttctacccaaggaaaagacgtgaaaatgacagctttttaatgctttttctgaaacttagaagtggaataaatgtatattataaaataatatattacctttgtgcccgatttatatttattacaagaactcaaaagattaatcagaatattttatgcgtagattaataacactattctttttggtatttactttgtcaggagtagcttttgctcagcagatgtcagatgataaggttgttcagtatgtaaaaagcgctcagcagatgggtaaaaatcaaaagcagattactactgaattaatgcggcggggagtgacaagggaacaagttgaaagaattcagaaaaagtatgaaaattctaaatctggaagtccgcagagcaatacccaagatgagaaacgttctcgtcaacgtggtgaaatgagtggcgtagtcaaagggttgcgtacaacttcggaaacgtattctgccaggcaaacggatgttgcaggggattctttacaaatgatggataatcgttccttgtctcaagagaaaggggcgggggatccgacttcgcaaatttatggtcataatatttttactaacgataatttgactttcgaacctaatgtgaatgttgctactcccgagaattatcgtctgggacctggtgatgaggtgattattgatgtgtggggagcttctgaaacaacaatccgacaaacaatatctccggaaggaagtattcttgtgaataatttaggaccggtttatctgagtggtaaaacagtaagtgaagccaataattatttgaaacaagaatttgccagaatatattctggagtaactggaaatgttccctctacccaagttaaattgacattaggagaaatacgttctattcaagtaaacgttatgggtgaagttatggtgcccggaacttataccctctcatcatttgcttccgtattccatgctttatatcgtgcaggtggtgtgaatccgattggtagtttacgcagtattaaagtgattcgcaatggaaatacaatagcagatttggatgtttacgatttacttatgaaaggaaaaatgaaggatgacatccgtctgcaggatggtgatgtaattcttgtggatccttaccagtcattggtacagatattgggtaaggtaaaacgtccgatgttttatgaaatgaaacccactgaaaccgtaggcacattattgaagtattcaggtggttttacgggtgatgcttataaaaaagcattacgtataatccgtaaaagtggacgtgagcatcaaatttataatgtggatgagatggattattctgtattccgcgtagatgacggtgataagataacggttgattccgttttacaacgttttgagaatcgtgtggaagtccgcggtgctgtatatcgtgaaggcttgtatcagttggacggtacgatgaatacagtgaaacagctgattaagaaagcagaaggacttcgcggagatgcattcttaaaccgtgctataatcgatcgtgagcttgaagacttgtcgcatgagattatacaagtagatgtgaaaggtttgctgaacgggacggctgcagatattcctttgcagaagaatgatattttatatatcccaagtattcatgatttgaaggaagaagctacacttaccatccatggtgaagttgccaatccgggtacatatctctattctgataaaatgacagtagaggatttggtgttgcaggctggtggcttgttggaggcagcggctacgacgaaagttgaagtggcacggcgtatgaaagatacgaagagtacatctttcagtactacagtaggccagaatttctcttttgatttgaaagatggcttattggtgggagaaggaagccaggatttccatcttgaaccttttgatgaagtttatattcgtaagagtccgtcttattttaaacaacagaatgttatggtgggaggagaagttctttttagcggtaattatgcactatcgaaaaaaaatgaacgtttgagtgacttgatagctaaggctggtggagtgactcccgatgcttatgtaaaaggagcgcgtcttattcgtaggatgaccgaagaagaatttcgccgtaaagaagatgccctgcgtatggcgcaagcgggaggtggagattccatatctgtaaaaaaattggatttgtctgatacctattctgtaggtataaatctgggagaggctttgaagaatcccggttcagatgctgatatggtgcttcgtgagggagatgtgttatttgttccggagtacgtaagtacagtgaaaatcaacggtgctgtaatgtatccgaatacagttttatataaaaagggtgaaagcttgaaatattacatcaatcaagctggtggttttggtaatgatgccaagaaacgtaaggtctatgtaatatacatgaatggtacagtttctcgtttaaaagcagggaacaagaaagccattgaacctggttgtgaaataattgttccaagtaaagaacagaaaaagaagatgactactgctgaaattctgggaatgggaagtacgacagcttctattgcagcgatgattgcgactatggttaatctctttaagtaatttgaattatgagcgaagaaagaatacaaaacataacctctccacaacctgaggaacaagaaatagatttgatagaactggcccagaaagtatgggctagtcgcaaattggtttttaaggcgtgtggtatcgctgctcttgtaggactggttgttgcatttagtattcctaaggagtactctacaagtgtgacattggctccggagagtggtggcaaatctggtggtggaagtatgggagcccttgcagccatggcgggtatcaatttgggcacttcttctggtgaggatgctttgtcacccgaactttatcctgatattgtaagttctactccttttctgattgaactgttcgatgttaaagtcaaggatcagaaagcaaaagtagacacgactttatatgcttatttgaaagaagaacagcgttctccttggtggagtgcaattttctccgctccttttaaagtgttaggatggacattgtctttgtttaaggatgaaccggaagagggggacgcaaagctggatccttttcgtcttactagagatgagtctgccattgcagatgctttaagtaaacgtatctctgtttccgtagacaaaaagacaggtgtgacaaccttgtctgttactatgcaggatcctttgatatctgcttcgctgacggataccgtgatgcattgcctgcagaactacatcacagattatcggactaataaggctcgtcatgatttggcatttaccgaaaaactttatggagaagcaaaggccagttatgaggatgcccagaagaaatacgcaaattttgtagatgcaaaccagaatataatattactgagttatcgcgcagagcaagagcgtttacagaatgaaatgaatttagcctatcaagtatatacacaagtgtctcaacaattgcagatggcaagagctaaggtgcaggagattacaccggtatatacggttgtccagccggctacggtacctttgaagcctgcaaagcccaataaattgatgattttgatcggcttcatgttcttggcaggtgtcggcagtgtgggatggatattatttgtaaaagatttattaaagggatggaaaaagcaaacaatatgatgacggataatgatatgatgtgctggcatgcattgtacacagcacctaagtctgaacataagttgatgcagcgtttgaatgctgcgggatatactacatattgcccgatgcaggctgtgtttgtaaaatggaaagggcatacccggaaggtgattacccctcttttttccggatgcttgtttgttgctggtaatgtggcggaagttgcctcattggcttcctcgcagaaggctgctatattactagataaagaaggaaaaagtttgtctattgaagcgggtaaagcagaacttcctgccaagtttgctcaattgctgaggttatgatgaagctgataacagaagagctgctggataccgttacttcacaagccaaggagaattcccgtttacgtatgaattataattttcatgcgtctatggatgcccctattcatcggttgctgaatgctttggaaccaggaacttatcttcctcctcaccgtcatacagataaggaagaaacttatctggttttgcgtggaagtctgctggcatttttttatgatgatgccggtaatgtaacagataaggtatgcctcaatccttcggaaggtaaatatggtctggagattccttctaatacgtggcatagtattattgccttggagtcaggcaccgttatttttgaaattaaaaaaggcccatatcagcctctaccctcagaggatttggcttcatgggctcctcagacttctgatgtggagggaataaaggcttttatgaagcggatgttggaactttaatatttttttgataaaacaaagaagcctcccgatatacaataaaatatcgggaggcttctttatgtaccatgttattagtcaaacaggctcttgaacttcttgaatattttctccttaatcgaagtgtttggcttgaagttatcagattcttccatttcctccaatgttttcttctcatccttgctcagcgtttcgggtacatatacgctgacatttactagcaaatctcccgtgccgtatccattcacgttgggcaaacctttgccgcgcaggcggagtacttttcccggttgcgtacctgagtcaatttttactttcacctttccatcaatcgtgggaatttctactgcaccacccaaggctgctgtcgggaagctgaggagcaggttgtaaatcaagtcattttcgtcgcgtatcaggttcgggtcttgttcttcttctacaagaatcagcaggtctcccggcataccgttgtgcttgcctgcatttccttttcctcccatagagagctgcataccttctgcgacacctttcgggatttttacggttactacttcttcaccgtatacaataccttcaccggcacattccttacacttgtttttgatgattttgccttcaccgccacaagttgggcaagtggttcttgtttgcatggtgccgagtatggtttgctggttacggattaccgtgccgctaccgttacaggtcgggcaggtttcggcgccgccgtcgccttcggctcccgtgccatgacagtgggtacaaggcacgtatttcttcagcttgaatttcttttccacaccggtagagatctccttgaggttcagttttaccttgacgcgcaagtccgaaccacggtaacggcgttgttgtgtgccgccacttccgccgaaacctccaaaaccgccaaaacctcctccactgtgtccaccaaagatatcaccgaacatggagaagatgtcgtccatggacatgcctccactgaagccgccgaacggaccaccattaccggcggcaccacccagtccggcatggccaaactgatcgtagcgggcacgcttgtccggattgcttagtacgtcgtatgcctctgccgcttccttgaatttctcttcggctgttttgtcgcccggattcttgtccggatgatattggatggcttttttgcgataggctttctttatttcttctaccgttgctgtcttttcgacttccaatacttcgtagtaatctcttttttccatacagttttatgttattctccgactaccactttggcatgacggatcactttgtcgtttaggatgtaaccggtttgtacgcagtccagaattttgcctttcagtgcttcattgggtgccggaatcacggcgatggcttcgtgatagtctgtgtcgagcggttgttcctttgtctctatcaccttaacgccgttttgtcccaatacagacatgaatttgttgtagataagttcaacgccttcttttacggcagctacatcggtagctgtctccatgtttttgagggcgcgttcaaagtcatccacaatgggtaggatactgctgatactcttttcaccaccgttcaggatgagttctgccttctccttcatggtacgtttgcggtaattgtcaaactcggcagacaagcgcagatatttgtctttctgctcttcaatctgttcattggccttttccagttcctgggcgagcttttcttcttctgttaggggagcttcgttttcttgtgaaacttcttgtcctacggtttcttcgtcacattcgttaggagtagcttgagttttcagctcctcttcctggttgttttctttttctttcggattcatattgttatgcttattattcttgtaaaatgattttgctttcattgctgttaagggtttaagttaatacgatatcagtgctccagcaaaaactttgccaaaacggatgtttttgccgaaaacgctgcaaaggtaatacttttatgtcagattgacagcgcttctctgtgtctattcatggaaaaataactatctttgcactcgcaattcgcagactaataggtattaaatagtaaattgtaaataaataaatcgtaaatataaagatgattacagtctctaatgtctcagtacagtttggtaaaagagtgttgttcaatgacgtaaacctgaagtttacaagtggtaactgttacggtatcatcggtgccaacggtgccggaaaatctactttcctgaaaacgatttccggggagctggaccctacgacgggttccatcatgctggctccgggagagcgtctttccgttttgagccaggaccactttaagtgggatgcttttacggtaatggacacggtgatgatgggacacacggtgttgtgggacatcatgaagcagcgtgaagtgctgtatgccaaagaggatttcacagacgaggatggactgaaggtttccgaattggaagagaaatttgccgagctggacggctggaatgccgaaagcgatgctgccgccttgttgagtggtttgggtatcaaggaggacaagcattatctgttgatgggtgagttgaacaacaaggaaaaggtgcgtgtcatgctggcgcaagctctctatggaaatcctgataacttgctgctggacgagcctaccaatgacttggatatggagaccgtgacttggctggaagagtacctctccaactttgagcatacggtgctggtggtaagccacgaccgtcacttcctcgactccgtttgtacgcatacggtggacatcgactacggaaagattaacctctttgccggtaactatagcttctggtacgagtccagccagctggcgctccgtcagcagcagaaccagaaggcaaaggccgaggagaagaagaaagagctggaagagtttatccgccgattcagtgccaatgtggcaaagagcaagcagactaccagccgcaagaagatgttggagaaactgaatgtagaagaaatcaagccgtcatcacgtaagtatccgggcattatctttacgcccgaacgcgaaccgggtaatcagattctggaagtttccggtttgacgaaaacgctggaagatggtacggtgctgttccgcgacgtcaacttcaatgtagagaagggagacaagattgtattcctttcgcacgacccgcgtgccatgaccgccctgttcgagattatcaacgagaatatgaaaccggatgcgggtaccttcaactggggtgtgactatcaccaccgcttacctgccgctggacaatactgcattctttaatacagacctgaatctggtggactggttgagccagttcggcgaaggcaatgaagtctacatgaagagttttctgggacgtatgctgttctccggtgaggaggtgctgaagaaagcaagcgtattgtcgggaggtgagaagatgcgttgcatgattgcacgtatgcagctgcgcaatgccaattgcttgattctggatacacctaccaatcacctcgacttggagtctatccaggcattcaacaataatctaaagacctataagggcaatatccttttctcatcccacgaccacgagttcattcagacggttgccaaccgtatcatcgaattgactccgaacggtattatcgacaagatgatggagtatgacgaatacatcacttcagaccacatcaaggagttgcgtgcacgtatgtacgcaacaaagtgataacggaagctaaggactaaataagcatattttaaatcgttccatcatgaggaaaaaatcgttccaccatggtggaacgattttttcaccacggtggaacaatatttctgccatgatggaacgattcttctttcatatcttttttgtttaataaaggcttgtgcgatattgaaaaaaagaagaaggtgtgttagaatgatttttagctatcattctgacacaccttcttttgctattaaaagagtctctttgttcttattaaggcggggaatagtctgggttattgtttctccttatatataattttgccttggctttcgccgaaaaggttgtcgcccagcgtggtaatcttattccccgtggcaagcacatagcgcaggttgtcgcatcccataaatgctccgtactcaatggcggttacactagcaggaagcaccagcgtgccgcacaaacgaccgcagccactgaatgcacgctgtccgatgcttctaagctcttgcgggagccgtacgttcagcagatacttcttttgggtgaaagtatagtcgggaattgcagtggcattactgttggtcatgtcgatggaaaccagattgggcatatagtcgcgtatcaatgtgaagtcggcttcgtccattttaccttcaacggtcagaaagttaacgtctttgggctgaaatccggctcttagcagttcgctggcaaggctgcccattttaccaatctgcacatttactgtcagtggttctccttcaatgaatgcaaaggtctcccatttctttttggtacggtaggagtcactgcatcccaatggaacaaatatggctgtaacgctatcagccaatgcttcggacaacagattgggagccgttttcttccgtatctggcatatcttgagatttttgcatcccttaaaggcagcatcttcgatgttcttggtcttgtcggaaaggataaccctagtcagtgtctccttgccaatgaaggtactgtcgtccatttgcttgcagaaggcatatgccggaatgcaattggcaggatatacgtaaaaacggtttggataagttccgttcttgcctgcatacgtgctgatagatgcgttcgagatgtccaactgctgcagattcttgaattcatctcttagatgcctgaagtctatggcattcagtttgccctgcagggttagttgggtaatttcattagcttccgcttcagtcatcagctccaccaaggtaccgggtttggctacgtagtatcttttggatttttgtgccgaggcattcagcattaacgccagtccggcaatggctaaaagtatttttcttagtttcatgtttattgattctagattgatttttcaaatataggaagaaaacggcaggaatacatgaggttttttctttttattattatttttgtcggatattaatcaatattgagatacaaatggagacagaagagacggtaaaggaagggcttgttacagcaagtaaagcaaaaagtatttggttggcattcgttgatatagtactgtttgctgtactttcaatgatttttctgtttttgtttgccataccttttgcattagtttttccggagttgaagacggaagttggtgaaacaaacatttactttcagatgctgaatgaagtcttgatgctggtcagtgggctgattgccgcttgtatggtgttgggctttaggaagcttcctttttcgggtttgggcttgtctttgaagggatggggcaggagcctgctgagaggagctttgtttgtcgtgttcttgtatgtagtcggttttggcttgtctttgctgttaggggcagtggaggtggtagggttcttgttttctcccatatctctgctggtcagtcttttgctttatttttttgtggcggttacggaagaagttatcggacgcggttttattttagggcgtatgctggatggaggcatcaataagtttgtggcattgtttatttctgcggtgttattttcgttgatgcaccttttcaatcctaactttgcctttgtcccgtttctgaatatcatggtggcaggttgtttcttgggggcttcctatatatatacgcgtaacctctgtttccccattgccttgcattggttctggaactggattcaaggttccgttttgggatataaagtcagtggaaatgaattcagcaatgagaatctgctgattcttcactttccggaagaaaatttaataaatggaggaaccttcgggttcgaaggctccattctgtgttcactacttttagtgcttggtacagtaattatcttaagacactattataagggattagagattaaggattaatacggaaaccattaaccattaatccctaatccttaatccctaattctgttccactcctttcattgtcagctgtatgcgtttccggtccatatctatgctgagtacctttacgcgtatatgctggtgaatggacactacttcattagggtctgatatgaatctgtcggcgagttgggagaggtgtaccagtccgttttccttgatgcctatatcgacaaatgcgccgaagttggtgatgtttcctacgatgccgggcagttccatgccttcgcgcaggtcgttgatggtgcgcacgttcttatcaaattcaaatatctttatcggtccgcgcgggtcacgtccgggcttgtccagctcttgcaggatgtctttcagtgtcggcatgcccacggtgggggagaggtagcgttccggattaatcttcagacgcagctcccggctggctatcagttcggctacgctgcaatccaagtcctttgccatctgttctacgatgcaatagctttccgggtgcacggcagtgttgtccagcgggttctttgcctgcggaatgcgtaggaagccggcacattgctcaaatgccttggcgcccatgcgcggcactttcatcaattctttacgggaggtgaaggcaccgttttcggcgcgatagttcacaatgttctgtgccagttgaggacccaatcccgagatataggtcagcaggtggctgcttgcggtgtttaggttgacacctaccaggtttacgcagttctctacagtttggtccagcgactttttcagttttgtctggtccacgtcatgctggtattgccccacaccaatagatttcgggtcaatctttaccaactctgccagtgggtccatcagtcgtctgcctatggacacggcaccacgcacggtgacgtcgtagtcgggaaactcgtcccgtgcaattttagaggccgaatagatggaagctccctgctcgctgacgataaatatctgcacatcgcggttgaagcgctgatgcttcaagaactcttccgtctcgcggctggcagttccgttacctatggctacggcatctattttataggactccatcatcatttgcagtttggcgaatgcctccttctgcttgctgactggagggtgggggtagatgttctcattatggagtagatttccttgtgcatcgaggcacacaactttacaaccagtacgaaatccggggtctatacccatcacacgcttttgccccaatggtgaggccagtagcaattgacgaagattttccgcaaacactttgatggcttcctcgtcggcgcgctccttgctttgggtcgcgaattccgtttctatggacggttttaacaggcgtttgtaagcatcttgcacagcttctgctacttgctgtccacaggcgttgttgctccgtacgaactgccgttctaggcgctccgcacactcttcgtcattggggctgatgctgactttcagcaaaccttccgcttcagcgcgccggatggcgagcagacggtgggaactgcatcgccgcaaggattcggagtagtcgaaatagtcgcgatatttggccgcttcttcttctttgcctttcaccaccttggcggtcagtgtgccttggcggacaaaggaactccggacgctgtttctagcccgttcatcttcacttacatgctcggctatgatgtcacgggcacctttcagtgcatcttccacgttcttcacgtctcctttcacataaccggcggcgcgttcctccggatggggctcacgttgcagcatcagcagggtggcgaggggttccagtcctttttggcgggctgcttcggcacgtgttttccgtttgggtttgtagggaaggtagatatcctccagtagggtgttctcccaggtctcctcgatacgcttctgaagttcggcggtcagtttgccttgttcttgaatggtgctgaggatggtttctttacgtttggcggtttcgctcagcttttcgtagtgggtctttatggattcaatctgcacttcgtccagtcctcccgtcacttcctttcggtagcggctgatgaaagggattgtcgctccgttttccagcaagccgagggtctggcttatttgtttttctgatatgccgagaacggcagatatcattcgatgaaaatcttgtatcattttgtatctcattttataaatagggggtaaaagtacaaaaaaacaattgttgttttttctttaggttccaacttttatctatatttgtcaaagctatggagcaattaaacgaatcaatcaattgaaacacatatatcgtacaatattaccatgcgtggtagcgcttttctgctgccttttgcctgttttctcaattacgggagagcatccggtattgattatcagctcctataatccggatgccggtcggacttccagcaatatctctgactttatggaggaattccaacgtttaggagggacaaataccgttgcattggaaaacatgaattgcaaaagtttttccgaagctcctttttgggaaaagagaatggcagggctattatccaaataccagaatgataaaagtccggcattgattgttcttattgggcaggaagcttgggctgcctacctttctttggaagactctgtacgcggcaatactccagtagtgagtgcgctatccagccggaacgccatattgttgccgggagataccatcgatttgaaaacttggatgcctgaatccgtagattttttcacggattttccggattcgcctatcaaggccggtttcgtttatgagtatgatgtggaggcgaatattaacatggtaaagcagatgtatcctgacaccgagaatatcgcttttatatcagacaacagttatggtggtgttgctatgcaagcctatgtagtgaaggaaatgaagaaatttcccgaattggatctgatactgcttgacggacgtgtcaatacaatatatactatttgtgataggttacatgaactgccggaacatacggcagtattaatggggacgtggcgcgtggatatgaatgatggttattttatgcgtaatgctacttatgccatgatggaagctgctccagccttgcccacattctctttgagttctgcaggtttgggatactgggctgtggcaggcatcgttcctgcctaccgtgctttgggcaaggagatggcaaggcaatcttatcgtctgctgactgacccgcaggatgggaatactcatatggaagtcattccgaatgagaccatactggacggcaagctcgtgaaggaaaaggaactgaatattgccaaccttccggaaccggtaaagatgctgaatgtaaccccttctttctatgaacagtacaagtatcatatctggtctgtctgtgctgtgctattggtgctgttgggcggtttgttcgtttccctttatttttattatcatacaaagaagttgaaggatgaactggaggtatccgaaggtgctttgcgagaggcaaaggaccgtgctgaagaatccagccgcctgaagagtgctttccttgccaatatgagccacgaaatccgtacgccattgaatgcgattgtgggcttctcggacgtgctgtctgccggaggagcctcggaagaagaacagcgtggctattttgaaattatcaggaccaactctgatttgctgcttcggctgattaatgacatattggatgtgtcccgtttggaggccgaccgcgtcatcctttctttggagagctgcaatgtagtgcagatatgccagcaggtagtagcttccgtggcccaggcacgtaggtcgaccaatcaattcctatttgagtgtgaacgtgaggtggtggagatgcggacggacgtgcagcgtttacagcaggttgtgataaatctgctttccaatgcggacaagtttacaaaggaaggtacgataaccttgaagctggaactggatacagcagggaatgtagcagtattttcggtgactgacaccggttgcggcattcctttggacaaacagaaacgggtgttcgaacgtttcgagaagctgaacgaatatgtgcagggaaccggcttgggcttgtccatctgtaagctgaccgttgagaagtggggcggtgaaatttggatagatcctgcctatacggatggagcgcggtttgtatttacccatcccatgaatttataaggactgacaagaaataaggaaatataatgaaaagatttagttgtttttttatctggatttttgtcctgacaagcatactgcctgcgcaggaaagagaggtgaaactgaaagtcgtacagaccagtgatatacacggaaactactatccctacgactttatacgccgccgggaggcaaccggcagtctggcacgcgtgcatgctttggtgcaaaaagagcgtgagacttatggcgaaaacctgattctcttggacaatggcgacattctgcagggacagcccactgcctactactataattacatagatactgttgctccccatctgactgcagagatgatgaatttcatggggtatgatgccggtaatatgggtaaccatgatgtagagaccggtcgtgccgttttcgaccgttgggcaggtgattgccgttttccgatattgggtgccaatattgtggatattgctaccggagaaacccatttcaaaccctatgaggtgctggaacgtgacggagtgaaaattgtggttctcggtatgataactcctgccattcccgtatggctttcagagaatctgtggaaagggttgcgtttcgacgatatggaggagactgcccgcaaatggatgaagattatccgtgagcaggaaaagccggatttggttatcggtatgttccatgccggtcaggatgcccagctgatgggaggcaagtatcgcgaaaacgcttcggtggaagtggcatgcaatgtgccgggattcgatattgtcctgatgggccatgaccatgctcgcgaatgcaagagggtgtgcaacatagttggtgactcggtactggtgatggaccctgccagcaacggtgtcgttgtaagtaatgtggatataaccttgaaattgcgtgacggcaaggttgttggcaagaagatagacggcatactgtccgatacgaaagactacggtgtcagcgaagagttcatgcagcgctttgcccccgaatatgcagctgtgcagaattttgtttccaagaaaataggttcttttaccgaggccatctccacacgtcctgcctatttcggttcttccgcttttatagaccttattcatgagttgcagttggcaatcagcggagcggatatttcttttgcggctcctttgtcctatgatacggaaatccgtaaaggagacatttttgtgaacgatatgttcaatctgtataagtatgaaaatatgctttacaccatgcgtctgacgggaaaggagatacgcgatgccttggagatgtcgtatgatttgtggaccaatcggatgaagtctccggacgaccatatccttctcttccgtgagaagcgccgcgaaggtgctacggatagggcctcattcaagaatttcagcttcaacttcgattctgcggcgggtattatctacacggtggatgtgaccaagccggatggcgagaaggtagccattctcagtatggcagacggtactccgttcgatatggataaaatgtataaggtagcggtgaattcttatcgcggaaacggtggcggcgaattgctgacaaagggggccggcatctcgcaggatgaattgaaggagcgcatcatccactctacggataaggacttacgctattatctgatgcagtacattgagcagaagaaggtgattgaaccgcgtgcgctgaatcagtggaagtttattcccgaagagtgggcggctccggcttccaagcgtgattatgagttcttgtttggcaaagttaaagaataattcactatctttgcggctcaaaatctatagtataagtttttggacgtgaagcagaagaaaaaaattataggtgcattgagcttgctggtactgtttatcatgtaccaggcaagtatcactgcgttcactcacgtccattatgtgaatggggtgatgataacgcactcgcacccttttcatggcacacactctcactctcagacttcccttctggttatcgggcatctgtcggtattccactcttccggggtggatgtgtatgaggttcagcacccgatgcgtcctttgctgtccatgctcagagccaaaccggcaacgcctactgtaaagggggaagttatacgtactctttcccttcgcgctcctcccgctcttttttcatagtcattaggtttaaaaacgcctggattttttgcatgtagataccaggtgttttagtctcgaatgtccggtatttcagtgaaagaagtgcggtatgtcggattattatcttttttcagacttgaattatttttttatttagagcgctaatttgatgaaacaatacattttggcgttggtacttgcagtggtaagtgccagcgtagcttttgccgtaaatcctataaaggaaggcaatatgatttccggccatgtgatagtgaaaggtacggaggaaaatataccgtatgccacggttttgattatcggcagcggtcagggaacggtttccaatgaagaaggacaatttgagttccgcaagcttccggcgggaaaatacaagctccgtgtgtctgccgtgggctataagacccaagagaaggaagtgacggtgagcaaggactttactgccgtcatacatttcccgatggaagaggagagttttatgaccgatgaagtggtggtatctgccaaccgcaacgaggtaagccgcaaggcagctccggtagtcgtgaatgtgatgagtaccaaattgttcgagatggtcaactccaccgaccttgccaagacactgaactaccagtcgggcttgcgtgtggagaacaactgccagaactgtggtttcccccaggtgcgcatcaatggcttggaaggtccgtattcgcagatattgataaacagccgtcccatcatcagtgcattgagcggtgtgtacggattggagcaaatccccgtgaacatgattgaacgggtagaagtggtgcgtggcggaggctctgccttgtttggagctaatgctgtgggaggcaccatcaacatcataaccaaagatcccatcaacaattccttccaggtatcgagtatgttctccaatatggacggcaagtcctgggagcaatatatgggtggcaatgtatcgctggttgccaaagataactcctacggcattgccctttatgagagttaccgcaaccgtaacccctacgaccgcgatggcgatggcttttccgagctgggcaagctgaacatgaataccttcggtttccgtgcctattaccgtcctacgcatttcagccgcatcaatctggaataccatactactaacgaacttcgtcgcggaggtaataaatttgatttgcagccgcatgagacggacattaccgagcagaccaagcatatcatcaatagcggaggcgtgagctacgatttattctggaaagagtacaagcataagatttcagcttacacctccatccagcacaccgatcgcaacagttactatggtgcccaaaaggacatgaatgcctacggcaagacgaaagacttgacttgggttgccggtggcatgtatgtaggcaatatggacaactgtttctttgctcccgctaccttcaccggcggactggaatatcagaacaactccctgcatgacattatgaccggctatcatcgtgacatggagcaggatgtccgcattgccagtgctttcgtgcagaatgagtggaaaatgaatgtactgaccatgttggtcggcgcccgtctggacaagcacaacctgattgacaagcttattttcagtcctcgcgtcaacctgctctacaagccgacagatgattttcaggcacgcttgacttattctaccggtttccgtgctccgcaggcatacgatgaggacttgcacgtaacggcagtaggcggtaagggtgtccaaatcaaactgtccgacaatctgcgtgaagagcgttccaacagttacagcggttcggtagactggactgcccatttggggcactggcaggcaaacattctggtggaaggtttctatacagacctgcgccatgtctttgtgctcgaagatatcggcaagaacgaagtaggggatgttattaaggagcgccgcaacggaaacggtgcacgtgtatatggtgccaatctggatgcgaggattgcccatggtaaggaggcgcagttccaactcggatttacggcacagcgcagccgctatacccatgaggaagcttggacaaaggtggacggaaaagaccttaccactaagcgcatgccccgtacaccggattattacgggtacttcactttctcttccgcaccggtaaagaattttgatttctctctttccggcacttatacgggaaagatgattgttccgcactacgcaccggaagatgctcccgagggtgccttctgtaatatcacttcagaccgcatggagcatactccccaatttctggatctgaatgtgaagttgaactatacgtttgtgcttcacgaccatatcaagcttcagttgaatacgggtgtacagaatatctttaactgtttccagaaagacctggataaaggggaattccgcgatgcgggttatttctacggaccgacgcagccgagaaccttttttatcggtttcaagataatgaactaaaagtttccatttaagaatttttagagctaaattccgcaaaatagtcctacatttgtcgccaaagcacaaaaaacatggatactaagagaatacggaatgtagacatttcccagatacatcatttgccgatgattgatttcatcggcaatgattttgctatttttaatgacatcaaggatatgcctttgagctcttatcccacccgtttgaatgctgcttgcctgactgtctgtttgaaagggtggtgcaaactggaactcaacctgcagcaatgtgaaatgcgggaaggtatgttgggcattattcttcccgaccagattgttctgcaacgggaacgctccgaagatttttccggacttttcattgctgtttcaaaggactttatggatatggtgatacctaccatgcagcagcttttccctatgttctttatgattaaggaacggccttttgtccacatcactccggaggaatcccaatcatttcaggagtatcactcttttctttggagcaaggtgaagctgaaagacaacccttttcgtaaggaaatcactcaggggctgctgttggcccttttttatgagatatataacatttatcaaggacatgtcgttcaggaacgcattcccaaaagcaggaaggaagacttgttcgagcgctttatccgtgccgtttcagagtcctataaagaagagcgaagtgtgtcctattatgccgataagatgtttctcaccgccaagcacctctccaccgtagtgaaagaaatcagcggaaagacggcaggcgaatggattgacagtctcgtagttttggaagccaaagccttgttgaagtcttccgaaatgagcattcaggaaattgcggacgagctgcattttgccaaccagtccttctttggtaagtatttcaagcatcacactggcatgtcacctaaagaatatcgccggcaataggttcaatgtgacggaataatgtttatttttgcggtaaagatttacccccaaaataaactatcatggaaaaaagagaaattgaccttactgtttcctgctatggaaaggtgaaaggagtgaagtatgacgttgtcatcttgccgtggggagctacggagccccataatctgcatctgccttatctcactgattgtattttgccgcatgacattgctgtagacgcggctgcgctggctttgcagaattccggtgtacgctgcatggtgatgcctcccgtacctttcggtgcacacaatccggggcagcgcgaacttccgttctgcattcatacgcgctactccacccagcaggccattttggaagacatagttgcctccctctatgcacaaggcatgcgcaagctgattattctcagcggtcatggcggcaacaacttcaagggaatgattcgtgacctggcgtttgtatatcccgattttctgattatcgctgccgactggttcagcatcgtctctcccaaagactactttgaggctgctgtcgacgaccatgccggcgagtctgagacttccgtcatgatgcattaccatcccgagctggtgaatctggctgaggccggtgacggagaatcccacccgtttgccattccttccttgaatgaaaaggttggctgggctccccgccattgggataaggctacagtcgacagcggggtagggaaccccaaaaaagcttctgccgagaaaggagaacgttatatgaagccggtggtggagaagttggcgaagctctttaaggaagtcggtcagggaagtttgtattgatatacttggcttccggctatatataaaaataggcaataaccgttgtggatattgcctattttttaagtgcaccctaaaaactaatctctttactcttacaaaaactaatctttctctatttcgagtacaaaattagaaggtttttacgggttatgaattgacataagtcaaaaatctcctttggatattattttttcaaacgtgcccaaaagcctttctttttctgccggaccggttcactgttttcgcgaaacagttcttcgtaggtcagtcggtcatgtatcatgcggtaaatgcttccccagtcaggcagtccgcccaggttgcggtcatcgataaagagatcggcttttactttgcgtgaaaaaccggtgtgtgcgatgtcttcttccggatagtcccggttgacggcatagaattccacaccccgttccctgcaccattccacagcttcctccaggagcttcccttcacgtaccgaccataaaatcagccggtgacgctcgtttatcagcatcttcagcgtagcggtggcaaagggaatttcttctcctatccgggggtagcggtgttctacaatggtaccgtcaaaatcaacggctatggtcataaatgaatagcttttattggtttcagactgtggagaaaattatccttgaccgcctgtggcgccgcccttcgccgagcaaccggtcttcgtattgcttgatgaggttgggggtaagctcttcaaaggtgatggaacggttgccggtgaagcggagaaaactgttcagtgtactggtgtatatgccggaggtgctatagcgtccggtttgccttatgcttcgtatcagtgaacttgtaaatgtatatatagaagtcataatctgaattttaagttttagaattgcatataaacgcttccgggactgaaaagatttcgtcccggtggaacttttcttcaggaagaaaagaggggttttcgtataaaactcagatatgtggccttcgggcagacaggaggagggttacagtatgcccgaacgtacccggctcagtgtttcgggggtcatcagcagataggacgcaatatgcgacaaaggagcccgcttgatgacctcgggctgttgttccatgagttgggtgtagcgttcgcgtgcagtctcaaatcgccaggaatcagcctttatttgtgagacaatcagggaatattccagaatctttcggtagaacatatttatttcccatgaaatttcggtgagcgtcaacagcttgttgtacggcaacagatatacgacgctcggctcaagcgcctcaatcatgagatgggtgggttcctgcttcagagtactttcgatgcagatgatgatgcagccttcataggaaaagtgctcggtgacgtctttgccattcttataatagaattggcgcagcataccttttcctacaagtacgatattatggcttacctgcccttcattgagtaacaatgcgcctttctcgacttccttgcggatgaggattttctctatcagctttcttccttcgggagccatactcggataacgggaattgacagtggcgtctacggtttctttcaataatgcatccataagaccatgatttatttgttcggtaagcaagaccggtaaagttcggtccgcttctgctttcggggagcaaagataggacttttggaattaaaaacaatttcggatgaagcttttgtttacccatttcatgccataccaacggcggacgaaaatgaatccacggatattctcgtccaataggaaggctacccacatgccgcagatgccccatccgagggggattccgaaaaggtagcccgctcctacagccacgctccactgcactaccaggcctacatagaaaggatagttgacgtcgcctgccgcacgaagggcgttggtggcgaaaatgttgatggggcgtccaatttcgaggaggatatctataataaggatggtggcccccatgcgtatgatgtcgggattggaagtgagccagccaaagatggcatgtcccgaaagggcgaggatgcaggacagcatgacggttatcatgacggatttcttcatgacgtatttccccataaggaaggctgcgtgaggtttcttctcgcctatcagatgcccgatacagatggcgccgccctgggccatggagatgctgaacagataagcgaacatgatgatgttgacacaataggtacgggtggcgagcgcttctactcccagcatgttgatgaagtaggtgatgacgacttgcgacgagctgtacgacaattgttcgccggcggagggcaggcctaccttcatcagattctttagttctatccatgggaaagggcggaagtatgccactgggaaacggtggatgtgcttgcggaacagtatgacgaacaggataatcatggagacgccccggctgaaggctgtagagatggcagcgccttctacgcccagttccggaaagccgaagcggccgaagatgagggagtagttgccgatgatgttgaggatgttgaccacaacggtgaccatcatcgggtagatggctttgttggcgctgcgcagggaggcggagagagtgagggataatgcctggaagaaggcgaaagcgcctacgatacgcatatagtccgtgccgtcctgcatcaattcggcggtgaggcccatcagccggaggatgggacgggcgcaggagaacagtaccaggctgaccgtgatacctaccgccaggttgacgaggatggatacgccgaccacttgcactactttcttgtgtagtttcgcaccgagatactgggaacacagaacggacgttccgagattgatgacttcgaaaacgaggaaagtgagcatgataatctggttgactacccctacggcggcaacactgttgtccgagtggcggctcagcatgatggtgtccaccgcaccgagcatcatgatgagaagtgtctctataaagatgggggcggccagcttggcaagccgctttttcaggctttcttgttgtatcattgtccgtgtatgtgcactatactttaaaaatcgcgcaaagataaggaaaggttgaaaaggacggtttgatatgtatcaaattttttttcttgttttagggtttgagtgttaacgtgttatctcaaattgcatgaaaacggtgaaaaaaatatgtaggaaagatttgcacagtccaaaagtttgccctacatttgcaccgcatttgaaaagaatgctggttataaaaaggaagtttgggtgagtggctgaaaccaccagtttgctaaactgacgtacgggtaaccgtaccgggggttcgaatcccccagcttccgccagatgcactcttagctcagttggtagagcaactgactcttaatcagtgggtccagggttcgaatccctgagggtgtacaagacaaatgcgagggtgggttcatctaacggttaggatacatgcctctcacgcatggtatacgagttcgattctcgtacccactacaaaaacaagaaagcggttgactgatgaaacggttgaccgctttttgttttttatttttctgttgtaatccgaaaatagtttctatatttgcacccgctatggcgaaatgtatattctatatcttgttagggttgttcctcatatcgaagttcacttccgtttctgatgatatggagggatgtaagacactccctaccgcggatgtgcattatttctccggaacccggtacaacttgtcgggggcagatggcagacaatgccagggaaaaggggaggacgcgaattacaattgcctggcagatgccggttgcataggaaataccttctcattgcggcatgtctcttgctcgaaattattgaggcttaatcctgacttcattgctgtcaaggtcgcgagaaccctgaaaactctgcttccggaagaaaagacaacttctttcccttttactttccatcctcataagatttcatatagatattatgtatatacgctgaggcgtattcttatttagtgcttttccccctctctttcgggagccggagagatttcccgtctccccatgccgagtttttctctatttttaagtactgataatcaatatataatggaatttctattggattttattctccatattgatcagtatatgattgatatagtgcaggaatatcatatgtgggcgtatgtcatattgtttctgctgattgtggtcattattatgatttccatactgccggccgtggtagaagtgctgcgtgcaagactgaaacaatgaaaacaaaaataaattaatatacttagtacatttttatccgttatgaagaattctttttttagccggttcacaccgaaagaaccgaaattctttcctttgctgaagcaattgtctgagattttattgtcctcgtcggctctgttgatagaaatattgggccatgactcgcctgagaagagggcggaagattataaacgaatcaaagatttggagcgcgagggcgataagctgaccaatctgattctggatgaactgggcactactttcattactccttttgaccgggaggatatccacgacctggcttcgggcatggatgatgtgattgatggaataaacagctgtgccaagcgtatcactatctataatccgcatcctatttcggacaaggggaaagagctgggacatatggtccaacaggaagcggccctcattgaccaggccatggatgaactggaagcattccgcaagagtccggataagctgcgcgcatactgcaaccaaatgcatgacatagaaaaccgggcggatgatgtctatgaattcttcatcaccaggctttttgaagaagagaaggactgcattgaactcatcaaaatcaaggagattatgtatgagctggagaaaacgacggatgcagccgaacacgtgggcaagattttgaggagcctgattgtgaaatacgcataaacggacggatgtatggaactattagtgattatcattgtgctggctctgatattcgattatatcaacggttttcatgatgcggccaattctattgccaccattgtgtctaccaaagtgcttacaccgtttcaggcggtgatatgggcggctttcttcaattttgtggccttttttatcgccaagtgtgtcatcggcggtttcggcattgccaacaccgtatcgaaaacggtgatggagccttacattactttgcctatcattctggccggtgtgattgcagccattgcctggaatctgtttacttggtggaaggggattccttcctcttcttcgcacacgcttatcggaggttttgccggagctgccatcatggcacacggttttgaggccatccagctgagtatcattctgaagattgcggcattcatttttctggctcccttgattggtatggtggtggcattcggttttacgttgttggtcttgtatatttgccgcagggcgcatcctcatacggccgagttgtggttcaagaaactgcagctggtgtcttcggctttgttcagcatcgggcacggtctgaatgattcacagaaggtgatgggtatcattgctgcggccatgatagccgggcattcggaaggattgggaatggggataaacagtattgatgacctgccggactgggtggcattctcttgttttacggccatttcactcggtaccatgtccggtgggtggaagattgtgaagaccatgggaaccaaaattacgaaggtgacgccgctggaaggggtggttgcggaaactgccggtgcgtttacactctatctgacggagtatctgaagattccggtgagtacgacacacaccattacgggagccattatcggggtaggggccacgaagcggctttcggccgtacgctggggagttacgaagagtctgatgaccgcctgggtgctgactatccccgtcagtgctttgctggcagcagggatttattgtatcgtatctcttttttagaagtgctgccgcataaaaaatagacgggttcgttttattttgcattaggtttgcactatctttgcagcttgaaactgtaaaatagaatgcacattggactggctatatagtttattcgttgaacactccgccttgcaggcggttgtggtactctcgttgatttccgctatcggattgggattgggaaagatacatgtttgcggcatttcattgggagtgacgtttgtattctttgccggcatcattgccgggcatttcgggttgtccatagacccgcagatgctgaattatgcggaaagcttcgggctggtgatatttgtgtatgctttgggcttgcaggtgggaccgggctttttcagttctttccgtaaaggaggggtacagctgaatatgctcgccacgggtgtagtgctcatcggcaccctgctgactgtagtgggcagctatggattgggagtatccctgccggatatggtgggcatactttgcggtgccacgacaaatacaccggcactcggtgcggcacagcagacattgaaacagatgggattggagaccagtacacctgctttggggtgtgcggtggcatatccgctgggggtggtaggggtcattctggccgtactgttcatccgtaagacgctggcgcataaggaagacctggaattgaaagagaaggatgatgtgaacaagccttatattgttgcgttccaggtgcacaatcctgccatcttcaacaagagtatcaaggaaataggcgggctgaacagctatccgaagtttgtgatttcccgcttgtggcgggatgggaatgtgagtattcctacttcggaaaagattataaaggaaggtgaccgcctgctggtgattacctcggagaaaaatacaccggcactgaccgtgctcttcggcgagcaggagcataccgactggaacaaggaagatatagactggaatgccattgacagccagctgatttcgcaacgtatcgtggtgacacgtccggagctgaacggcaagaagctgggctctctccatctgcgtaatcattacggtatcaatatcagccgggtttatcgcagtggcgtgcagttgttggccacagcggaactgaccttgcaattgggtgaccgcctgaccgtagtgggcgaagccgctgccatacaaaatgtggagaaggtgctgggcaatgcagtgaaaagcctgaaggaaccgaacctggtggcggtatttatcggcattgtcatcggtctggctttgggagcgattcctatttccattcccggcatcagcgctcccgtacggctcggattggcaggaggtcctatcatcgtaggtattcttatcgggacattcggtccgaggatgcacatggtgacttatactacgcgcagtgcgaacctgatgctccgcgcattggggttgtctctttatctggcttgcctgggactggatgcaggtgcccatttcttcgatacggtattccggccggaaggactgttatggattgccataggttttgcgctgactgtggttccggtattgattatgggtatcgttaccttcaagtggctgaagatagatttcggaacaatggcaggtatgctgtgcggaagcatggcaaaccccatggcgctgaactacgccaacgacaccatcccgggagacaatccgtctgtagcgtacgctacggtctatccgctgtgtatgtttctacgggtaatcatagcccaagtgctgctcatgttcttcattaatggataatggggaatggagggcactattaattatcaactatcaattattcaattaaataactatgggaaatataactccggaaagtattgtcaatgacttgcgttatttgcaattattatcacgcagttttcctaccattgctgatgccagtacagaaatcatcaatctggaggccattctgaatctgccgaaaggtacagagcattttctgacggatattcatggcgagtatgaggcttttcagcatgtgctgaagaatgcatcgggggcagtgaaacgtaaggtgaacgaaatattcgggcatacactgcgcgaaagtgagaagaaggaaatctgtacgttaatttattatccggaagagaagctgcaacttatcaaggagcaggaaacggacctggatgactggtatttgataacactgaaccagttggtaaaagtatgccagaacgtttcgtccaaatatacccgttcgaaagtacgcaaggcacttccagcagagttctcgtatatcattcaagagctgttgcacgaatcgagcatcgaacctaacaaacatgcctatatcaatgtcataatcagtaccattatctctacgaagcgtgcggatgattttattgtggcgatgtgcaaccttatccagcgcttgaccatcgactcgctgcatatcgtgggcgatatatacgaccgcggaccgggtgcgcatattatcatggatactctctgtgattatcataatttcgacatccaatggggtaaccacgatattctgtggatgggtgccgcatcgggtaatgatgcttgtatagccaacgtaatccgtatgtcgatgcgctatgctaatttagcaacgctggaggatggttatggcatcaatctgttgccgcttgcaacgtttgccatggatacctatgcggatgacccttgcaccatctttgcaccgaaaatgaactttgccgatgcggaatacaatgagaagaccttgcggctgattacacagatgcataaggcgattacggttatccagttgaaactggaagcggaaatcatcagccgtcgtcctgagttcggtatggagaaccggaaactgctgcatctggtggatttcgagcgtggtgtgtttgtatacgaaggcaaggaatatccgttgcgcgatgtgaatttccccaccgtagacccggcggacccgtatcgtctgtcggacgaagagcgcgaactgatgcaccggattcattcttctttcatgaacagcgagaagatgaagaagcacatgcgctgcttgtttacgtatggcggcatgtatctggtgtgcaacagtaacctgctttatcatgcttccgtgcctctgaatgcggacggcagttttaaacatgtccgcatcggccaaaaggaatactggggacgtaagttgctgaaaaagaccgaccagctgatacgtaccgcttactttgacgaggacggttcggacgagaaacagtttgcactggattatgtctggtacatgtggtgcggaccggatgccccttccttcgataaagacaagatggctacctttgaacgctattttgtggccgacaaaacattgcataaggagacgaaagggcattactatgctttgcgcaacgaggctgaggtgtgtgaccgcattcttgaagagttcggcgtgaagccggggccacattcgcatatcatcaacggacatgtaccggtaaagaccattaaaggtgagaaacccatcaaagcggatggtaagctgctggtgattgacggtggtttttcaaaagcctatcagccggaaacgggaattgcgggatatacgctggtatatcattcccacggcttgcagttggtgcagcatgagccgttccagagccgtcagaaagccattgaagaagggcaagacatcaagtctacaaccctggttgtcgaattcaattcgcagcgtatgatggtgaaggatacggataaaggaagtgaactcgttacgcagattcaggatttgatgaaactgctggtggcgtataggacggggctgattaaggagaaacaataatttataatttcagtatcgtcaccccgccctctacaatgattcctttgtcataggttttcccttgggtgtagtagcggctgccgccataaccgccggtgaggaatatgccaaagcgctcggtcaggtggtattccagattgacacgtgcctggagggcatagagacgtgccggaatgccgtagtccttgttcttgaaggtttctatatgttggtatcccagatctccgctgatgaacagctgtttgtagagcggtaattcaagaccggcacggtagaagagggaagcggaaaacttatcgccgaaatccagatactgggtaccgccgccgaggatggtatagaagagccggttcttgaaacgggcacctacattcagcttggtggcattaccaccgaaaaacatcagttgaacttttgtttggggattggcattgactaatcccaactggaagccgtctaatttttctttgtagtagttgaatagacctatttgaagccctttggcgcgtatagccatattggcagcacctatttgtaatcctcgggctgtaccacccaccacattgcccaggccggaaacctgaacaccggtcatatctccggcagtgatgttggcaagggcagacatctgcatgccattcaagtcttcaccgattacgcttagcaggccggctcctgaaaatcctttgaaatttccaccggaaatattggcgagtccggcaaagtgtatgccggaagcaccttctccgctgatattcaacaagccgcctatggaggcgccacgattatagtccccactgatgtttgccagaccggaaataatgatgccttgcgcatgatttccgttgatacctaccagtcccgaaacggatactccgataaggttgttaccattgatgttggtaattcctgctatctgcacgcctcgcatgcttccccccaccatatttgacagacctgccatctgtacaccgttcacatccctgccggttacactgccaagaatattcatgccgagaccattcagacggttcatggaggagaacacacccagattgaagcaggtgcttcctacggtgtcagtccgctgtgtggagatgtttttccataaggagatattgatacctaccgggccatggtctgttcgtggagagtgttgtttccggaaagtattttcggaggatttctgaatcgtgtccggctgtacgctgcccggattatgttcttgggcaagagttgtccctgcaatgagcagggatgtaaagaagaataaaaggagttgtttcatattggttgaaccctattggctttatcctttggcctcctgatacaagaagcgcttgatagatttcttcggcgttttttcaaattcttcaggatagattttcattttgaatatctggctgtatgcgggcagttctgcattcagtgccacacggttttcctccatgacgcgttcgatgtcgtcattgttcagcccatgggcaaaggcatcatcgaagtcgggataaaccagacctaccagtttctcgttctgctgcacgatgatgctttcggctacgtacggcatattgttcagtttgtcttctatctcttccgggtagatattctgaccgctcgggccgaggagcatgttcttgctgcgtcccttgatgctaatgttgccttcggcatccatcagggcaaggtctccggtgtgcagccagccgtctttgtcgagtacctgcacggtggcttcgtcgttcttgtagtaacccagcatgacattgggaccacggcagacaatctctcccggaatgttttcgggatcggatgataggattttcacctccatacgcggtgcggcctttccgcaagaaccgggtttgaagcgggtccaatcctcgtaacagataatggggccgcattccgtcattccatagcctaccgtataggggaaatctatcatctttaagaactgctccacttcctggttgaaggcagctcctcctacaatgatttctgtaaagtttccgccaaaggcttgaatcatctggtcgcgtacggtcgcttttatcttgtcgttaatgatgggtactttcagcaacagcttcatggcgggagtttccagcttgggcagtacactcttctttataatcttttcgataatgagcggaacagccacaatcaggttaggcttcacttcggtgaaagcctggaaaatgattttggggctgggcatgcgagtgaggaagaatatgtggcaacctacggcgaattcatacagaaactcgaatgcaagtccgtacatatgtgccattggcagcatggagacaatcttgtcaccggctttcagcggcaatacttcgaaagcaaaagtggtgtttgaccaaaggctgcggtagggcagcatcactcctttggagtaactggtggtgccggatgtatagttgatgaccgccagttcgtcgggctggtctttgtgataactgacatgttccttgcggaagttcttggggtatttcttaccgaacatttcgttgagatgttcgcgggcatagtccaacttttcgctgcgggagacaagaatgtagaagtctgccatcatcatgatgccctccagcagcggcatggcactttcgttgaggttttcccaaacctggtcgcctacgaaaagcagtttggcttcggaatggttcacgatgttgtgtacattgtctgccttgaactcgtgaaggatggggacgattaccgcaccgtaggtcaatgtcgcgaggaatgttacgccccagtgggaactgttgcggccacagacggcaatcttatcgcctttcttgatgccgcttgcctcgaaaatgatatgcaacttttctattttgcgggctacgtccttatattgtagggttgctcccttgtagtcggtcagagcgtctaaatcccaattttcctttatgctattctctatataggcgataaaactttgttccatgatatttaattgcacatttgattgaaaattgtgcaaatataagggtttatatatagaaagcaaacttttataaggaaaatagtttttatggcggctatttgctaaaactcgacagttatacctaaagtaggcaggatagtgccgctttcctgcttgaggtatttcattttatagcgctgttcggcaacaggagcggacggattttcgatgatgcccgtactcattatcacatccggctgtttcagtttgttgccggtgatattctgtatgtccaggtagattcctatcatgcagtgatggaagtagaaggacttgtccacacgcaagtctaactgggcaaagttgggcagccgcccggtattatagtacgcatagtcgtagtagggctgtcctttggcatcccatgcttctacgagtgatgatttgtcttcatcatagggagtgtaggggctgccgcctatatagcttagcttgcctcctatgctccagcgccggggcaggttgtatgtaccgctcatgttgagtatgaaacggttgtcccaggcagatggaatgaagtcttcatttgaacggttgcggtattcgctgcggtataaggtgaaggaggatacgagattgaacttgccggatgcctgccagcggaacatggtttccagtccgtaggccctgccgctggctgtagggacgagtgcttcattgccggtgacaccgtaatcgtttcctttgcatgccaacggaatgttgtcttgaagggaaagtggcatacggctgtaacgcttgaagaaaccttctgcagaaaccatgaaccggtcttgcaggtgccagtccagaccgaggctactttcaaagacctgcatgtacttcaggcctttgttgagatattgctcttcattgtctttatatcccaaagcggtgtagggaggcaattggtggtagaggccggtacttccgctcagggtccattgttccgagagtttgtaggatgcagagaggcgtggggagaactgtttccatagctgccgcatctttcggttgtaagtgttgccgtccatacggataccggcggaaagggcgagacgcttgtcggcggtggtatagtcggaagagaagaaagcaccccagccgaagatgttgagtgaggtttcgtagatggaaagcgtacccgaatgactgccgtatagtctttgccggctgtggtttgtatagatggagttgttcagttctgctccttcttttagggtccatgctcccaagcgcgtctggttttcaaaacgcagggtggtcttttgctctgtggagcgtaggcgcagggtcaggttgtcttcggaagagtcatcgttgttgcggtatttcagattgcggttgttcaggtagttatggctcagtataagggattgcacgtgtcttccattgtagtgtctgtaagaggctccgagagtgaatgtttcctgatggatggtggggagatagctgagcagatattcggcatcttctcctttttcatcggtattcagtttcatcttgtcaatgcctacgagaccaagcagggtcagctcgctgtgcttgttgaaacgggtttttgttttgaattgtccgtcaatgaaattgggcaggaagggcagtcccaaagccttgaacaaaagttgcaggtaggactggcgtgcagagaacagataagtggtgcgttgtcccaggtgtcctgctccgctgagcgagacttctgatgcaccgatggtggctttgaacgcctgcttgtccggattgccgtccttgaggcggaagtcgaggacggaactcaaggctccggagcggttggcggggaaggcgcccgtataaaatgtaatctcgcgtatcaggtcggcattgacaatgcttaccggtcctccggatgcaccttgagtggcaaagtggttgatgttgggaatttcgatgccatccatataaaagcggttttcggaaggagaaccgccccgaacaatcaagtcgtttcgatagccgatgggagagaaagagacaccgggataggagcgtacgatgcgcgagacatcccggttggctccgggacttttctctatttcctgcaggccgatgatacgcatgctgaccgggctttcgatacttcgccggaagggggaaggcatcaccactactgtgttcagcagattggcatcctcttccatctctatctcaatgaacggagttgaggctgaaacgatatattcgggggtggaaacagtctggtatcctatgcaggatgcctcaaggctataaatgcctggaggcacctgctctatcttgaatgtgccgagtgaatcggtggaagcccctttcccggggataccggcaacgaaaacgttggcgtaggccacgggttgtctggactgtctgtcgatgactttgccgcgaacggaataggtcacgggaaccatcatggcatgtacggttgggctgatacctgataaaagtatcagcaatataaacaatatagctcccaccttgtgccgcatgacattcatggctaatcagacgtcactaattactttcccaagtaccatcggtacatgcgttgcacaccttcctcgatatcaatcttatgatgccatcccaatgcatgtaacttgccgggatcggtcagtttgcgcatggtgccgtcgggtttggaagtgtcgaaggtcagccggccttgataacctacggtgttgacaatcagttctgccaactggcggatagtgatttccttgcccgtaccgatattgatgtggcagttgcggatttccttgtcgtccggcttgaaggtatctttgaagtcgacgtgttccatgacgaagacgctggcatctgccatctcctcgctccagaggaattcgcgcaagggggtgccggtaccccataatctcacttcttcttcgctgatgccgtatttccggaggatattcagaatgtcctctttgctgctgtcgccgttgatgccttctaccggacgcaggttcatgtcgtggcgtacggcattccagtcgccttgtttcaggcagtgggcaaggtgtatcttgcgtatcatggcggggagcacgtggctgcgttccaggtcgaagttgtcgttggggccgtaaaggttggtgggcatcacggcaatgtagttcgtaccatattgaagattgaagctttcgcacattttcagtccagctattttggcgatggcatagggctcgttcgtgtattccagcggagaagtgaggagtgcgtcttcttgcatcggctgttcggcattacggggataaatgcaagtactgccaagaaagagaagttttttcactccgtggcggaagctttcaccgatgacgttctgctgtatctgcaggttcttgtagatgaaatcggcacggtagatactgttggccataatgccacccacaaaggcggcggcaaggaatacatattcgggctgctcctcatcgaagaagcggcgtacagcaactccgtcgagcagatcgagttctttgtgggtcttgccgatgagattggtgtatcctttctcctgaagatttttccagatggcagaacctaccagtccccggtggcctgctacatatattttggcatttttgtctaacattattgtctgaaagtttaatagttcattcaaagctctttgcttcttaaatacagtttcttcacaaatttcatgtcgtgctctgccatgatgcgtaccaactcttcaaaactggtctgcctcggattccatcccagcagtgtttttgctttggtggggtcgcccagcaattgttccacttcggcaggccggaaatatttggggtcgacttccacgaggacttttccggtctgtgtgtcgatacccttctcatccactccctggccttcccagcgcagagtgatgcctacctcccggaatgccagtgtcgcaaattcgcgtacggtatgcatttctccggtggcaatgacgaagtcttcgggggtgtcgtgctgcaggatgagccacatgcactcgatgtagtctttggcatatccccagtcgcgccgggcatccagattgcccagatacagcttgtcctggaagccttgggcgatgcgggcagccgccagtgtgatttttcttgtcacgaaggtttcacctcggcgttcgctctcgtggttgaagagtatgccgtttacagcaaacatgccatagctttcgcggtagttctttgtaatccaaaagccatattgtttggctacgccataaggactgcggggatagaacggggttgtctcgctttgcggcacttcctgtacttttccgaaaagctcggaagtggaggcctggtaaatgcgtgtcttcttttccataccgagaatgcgtacggcttcgagcatgcgcagggtgcctacggcatcggtttcggcggtatattcgggcacgtcgaaggatactttgacatggctttgggcggcaaggttatatatttcgtccggctgcacactctggatgatacggatgagagagctggagtctgtcatgtctccatagtgcaggttaatggtacgtttctgtttcatgtcgcgtacccactcatcgaagtagaggtgttcgatgcggccggtgttgaaagaggaagagcgacgcaggataccgtgcacttcatatcctttctgcaggaggaattcggcaaggaacgagccgtcctgcccggtaatgccggagataagggctttcttcataatgtatgctttttgttattatgtcttttcggactgcaatattcgttattttccacgagatggcaaaatataaactatttctttcccatcactttgtcgataatcagtgcgattgccccgtcgcccgtcacattgcaggcagtgccgaagctgtccatcgctatgtatagtgcgatcatcagcgcttgtgccgactcgtcgaagcccagcatggattgcaggatgcccagtgatgccatgatggcgcctcccggtaccccgggagcggccaccatagtgatgcccagcatgaagatgaatcctgcaaatagagggaaatcatggggcatgccttgcattatcatcagtgccagggcgcatgccacaatcttcaatgtgctgcccgacagatggatggtggcgcaaagtgggatgacgaatccggcaatatcggcagagacgccgttcttccgactctgctccaatgttacggggatagtggcggcactggattgagtgcccaaagccgtgaagtaggcaggtatcatccgtcccagtagtttgagagggttcttgcggacaaacagtgccgcaatgctgtattggaataccaggagaaagatgtgaagcaggaagattacaccgataatcttaataaagaccatcaagatgccgaatacttgtccactgtgcgtcatgttgaggaaaatgccgaaaatatagatgggaagcagcggcaatatcactgcactgatcatgcggatgacaatctcttgaaaatcgcgtgccgcatttttcagtacctcacttttcagatgagccagacccagccccagtgtgaaggcaagtacgagtgcggtcataacattcatcaagggcgggatgcccacggaaaaatagggaagaatgccttgagattcactgactttttctaacggtaccccggtttctatgagggaaggaaataccgccataccggtgaagtaggagagaaaaccggagaatagagtagctccgtaagcaatgagtgccgtaacgaccagcatccgtccggctcctttgccgatgtcagcaatggcaatcgtgaccagtcccacaatgatgagggggatggagaagttcaggaattcactgaaaatggcattgaaggttacgaacagccgtaccagcgaagccggtaggaaatttccgaaaagtatacctaagataatggcaatgatgatgcgtggcaataatccgatgtggaagttcttcatgagcattggttttctttctggttgaaaaataggctttcgctgacaaaagtactattttattttcgtaattcatacgaacaaatgctgttagcattttgtttccatataaagacaaaatttacatgaatatgaagaatttaaataaaacagacattggacttatcggtctggcagttatgggcgagaatttggccctcaatatggcagataagggatggaatgtttcggtatataatcgtacggttccgggagtggaagaaggggtggtggaacgttttgtgaacggccgcgccaaagggaaaaaaattgaaggctatacagatatagccgaatttgtaatttccattgccataccccgcaaaataatgatgatggttcgtgctggcagtgcggtggatgagctgatggaacagctgtttccccatttgtccgaaggggatatcctgattgacggtggcaattccaattatgaggacaccaaccggcgtgtggcattggccgaaaagaaaggcttccgttttgtgggagccggagtttccggtggagaggaaggagcactgaacggcgcgtctatcatgcccggaggctctgaaagtgcctggcctgaggtgaagcctatcctgcagagtattgcggcaaaagcatctgacggtactccgtgctgccagtggattggtcctgccggttccggtcatttcgtcaagatgatacataacggtatcgaatatggagatatgcagcttattgccgaagcttattgggtgatgaagaatctgctgggtctggacaatggacagatggcggaaatctttgctgattggaatgagggcaagttgcgtagctatctcattgaaattaccgtcaacatactgcgtcataaggacaaatcagaaggttacctgatagataagatattggatactgccggacagaaaggtacgggcaagtggtccgttatcaatgcgatggagctgggcatgccgctggggttgattgctacggctgtgttcgaacgtagtttgtcggcacagaagggcttgcgtgaaacggcttccaagcaatttgtatgccgacgctcgcaggcagtgtacaacaagtcggagatggtgaaggatatctattccgcactctatgcttccaaattggtgtcatatgctcagggatttgctgtgttgcagcgtgcatccgacgcttttgcctggaacctcgatttggcatccatcgcccgcatgtggcggggtggctgcatcatccgtagtattttcctgaacgacatagctacggctttcgaggctaaagacaagcccaaacatctgctgttggcaccttatttcaaaaatgaaatgcagctgctgctttccggctggaaacatctggtggcacaatccatgaaagaggaacttccggtacctgcattctcgtccgccttgaattatttctattcgctggtgtctgccaagttgcctgccaatatgattcaggcgcaacgtgactattttggtgcgcatacctttgaaaggacagacgagttgcgtggacagtttttccatgaaaattggacgggacacggaggagatacgaaatcgggtacatacaatgtgtgagaaaggggagaagatgatgaagaaattagtgattgttatattcggtgcttcgggtgacttgacgaagcgcaaactgatgccggcgctctatactttatatagtggcgggcggttgccggaaggattctccattctggggataggacgcaccgagtatacggatgcccgttaccaagaatatataatgggtgaattgggtaagtttgtagcttccaaagagcaggtggaagataaaatgaaggatttttgcagccatctgcattaccagactttggaccctgccgaggttgaaggctatcatctgctggacggacgtttacaagagtttaccggtgagaagaaaccggacaacctgctgttctatctggctactccaccttccttgtacggtgtcattcccttgcacttgaaggcggccggtctgaaccgtcctgatacgcgtatcatcgttgaaaagccgttcggttacgatttggagtcggccagaaagctgaatagcatttatgcttccgttttcaaggagcatcagatttatcgcatcgaccattttctgggtaaggaaacggcgcagaacattctcgccttccgttttgccaacggaatcttcgaaccgctatggaaccgtaattatatagactatgtggagattacagccgtagagaatttgggtatcgaaggacgtggcggattctatgaaggtgccggagccctgcgcgatatggtacaaaaccacctcatacagcttgtggcgctcactgcattggaaccgcctgccgttttcaatgccgataatttccgcaacgaggtggtgaaggtctatgagtcattggcccccttgaaagaggaggatttggaggaacacattgtccgcggacaatatacggcttcgggctcgaaagccgggtatagggaagagaagaacgtggcacctaattcgcgtaccgaaacgtatattgccatgaaaatcggtattaacaactggcggtggaagggtgttcctttctatatccgtaccggcaaacaaatgccgacaaaggtgactgagattgttgtacatttccgtgagacgccccatcagatgttccgttgcgagggtggacattgtccccgcgcgaataagctgattctccgcctgcaacccaatgaaggcattgtgctgaaattcggcatgaagactcccggaccgggatttgacgtgaagcaggtgatgatggacttcagttatgaccagttgggcgggttgcctaccggcgatgcctatgcccgtctgatagaggactgcatacaaggtgatcctacactctttacccgcagtgacgcggtagaggcttcatggcgctttttcgatcccgtgttgcgttattggaaagagcatacggatgctcctttatatgggtatcccgtaggtacgtggggacctttggaaagtgaagcaatgatgcacgaacatggtgctgagtggaccaatccgtgtaagaatttgactaatacagatgaatattgcgagttatgaaaagttatgtttaccattcggctacagctacggcgcatgcgttgattgaacatttgattgcgatgatggagcgtgaaccggaaaagaccttttattttgcattcagtgggggaagtactccttcgctgatgtttgacatttgggctaacgaatacaaggaggtgactccttggatgcggatgcggatttattgggtggacgaacggtgtgtgccggcagaggattatgagagcaattatggtaccatgcgccgtttgctgttggatgaagtaggcatgcccgatgaatacgtttaccctatttatggagtgaaccgcccggagattgaagcaaagaactattcgacgctggtttgccgcacggttccgctttggggtggcttcccggccttcgatgtcgttttgctcggtgctggagacgacgggcatacctcctctatctttccggggcaggagtatctgctttcttcctttcatccttatgaggtgagtgtcaatccctataatgggcagaaacgcatagccatgaccggctgccttttgtttgctgcgaagaatcttattttctttgttaccggcaagaataaggcggatgtggtccgcgatattcttgattccggggataccggtccggcagcttatgtggcccaccatgccgagcgtgtggaattgttcctcgatgctcaggccaatggcgggaaaatgtttacttagatgtgccgctctccagaatgcttacgatggagaataatgtaaagcagatgcctcccaaaccagccagtacacgtgcaggtacaaaataggcattgtgcaggtttgccatctcaaacagaaaggcggagagaaacagacaagccagggctgtgaagaccggaatcagcgggatgcggttggccagcttgaaagtgttccgccagatggcggcaagcaggatgactttgctggaaatgctgtagcataccagtcccagacctatcataatatatcctgtggaggagagtgccggattgctgttggctaagaccagaagtccccagagaatgctgatgctgcccattatcaaaacaagggctggccaccgtttccgctcagcctttgtatagttgttgcgtatctggcggacgatggttgcaaccagcgccaccaggctggaacagatacaagcaagtcctgccatgacatggcctgctacataatatgcattgtgcccgctgctttttgacaatagccagaaggcccatatccatgccattactgccataagggtggcaactgctattaggatatatccctgggaggaattgaatgcatcggcaggttgtagctggtcggtacgttccgagttggcgggaatgagggtgaagcgggtggaggctgtggctgtggtagctacacaagctgtgatgaaaccgactccgcaaatcacgtgtcctgctacgaaattgcttgccgtggcagcttcgtgcatataattccaaccatagattactgtgagtatggctgccaggtaaccgataaccggaagtgcgtatctggctatcggattgtaggtatgaataatttgtctaatgattgttgccgctgtggcgaacaaggcaatgcaaatcatccctaaggaaaatactaccggaccggccacaaattttgccgagtccactccttcgtggagcacaaaggctccgtagccgaaacagaaaagggccatcaacaagggtatggccctgaaaagaatactgataccgtaattcataactgttgtttttagagtttccccttcaaacagcgtttctgcggctttgttcctccttttaagatttatttgtgatgagaagtgcttgtctgtccgtatttagggagccagcctctcctttttccagctgccatccgcttgttgggaatagaggaaacggtcgtgtagcctgctttcccgtccttgccagaattcaaaacggaaaggggtgacggcaaaacctccccagttgtcgggacgtttgatactttgccctacccatgttgccgcttcgcggacgaacgcgcgcattatctccatacggctgccaatgacgtgactttggggtgaaatcctcgccccgattttacttttgtaaggtctgcttgcaaaataggtgtcagaatcggcaggagcgcatctttcagcttttccttcaatgtgtatttgcctttccagtttgtgccatacgaaagataaggatatatacggatttgcagtcagttgccggcctttcctgctttcgtagttggtgaagaagatgaaccggccattttccacccctttcagcaacactgtgcgtgtagagggatgcccgtctgtcgaggctgtagctaccgtcatggcggtgggctcgtactcatcactatggatagcatcgttcagccaatggtcgaattgctcaaggggattgtcgttgaggttacccggcgtcagtctgcctttcttatattctcttctgatgtcaaagagttgtgatttcattatcgtgtggttttatcaagaatgatgtttttctatgtaacagtctgagagggctgaatgtttttgtttctctgcggaaagaaaatatggaagaaggaaatggttgtgttgatacttaaaaaaatggcatcccgattgtggtggctatcgggatgccggatattggagattactttatggagacaagtgggaagtggacactggcatgtctgctattgcaatttaaacattacgggaactgtgaatttacaacggaccggtttgcctcgttgctcaccgggtttccatttgggcatggtggaaatcacacggatagcttctttatccaggtagggatctacgcctcttactacttttacatctacgatgctgccgtctttgttgacaacgaattgtactattacgcgcccttgggttccggtttcttgtgcaatagtcgggtattttatgctcttacccagatattgcatcagactcatgccattataagaaaactcaggattcttctctacaacttcaaaaatctcgtcctctaccggaatctcttcatctacggttggagatatgggtttgatgattacagcttcaccgatttcttcggaagaggcaatggctgtttctttcacattgtcattatcatccacaattgtcaatacctcggcaattgcaggagcttgagtgggtggcggagctgctaattcgggttgctccgtgataggaatttcaatttcctgctcaaatacgttctcggtaatagcaccgctcatgtcaatcataacatcacgcttcgaccattcaaatgcaacgaacatgaagaccagcacaattacataacctacaagtagccaatttgacttcttgttttccaggcttgctttggatgttttcttgatttccataatttataagattattactgtataatggttgtcgcgaaactaatattatacagatgtgattagtaaaatcataaaacatgcgtgcccacttgtttctgcattaaagataagaaaatgaatgttatgttgttgtttgatatatggttatatatagttttttaaatttgctttgataatttttccgcttatgaattaaatagtgttgaggtgcaaaaaagcgcttccaatgttcgcttatggagaaaggcttcacacaaaaacaaattgtatttatagtattgaaatgcggttatagcttttgtatcaattctttagtatgttggttggaatcagatgctggcaataaatatagattatatatgatagccatttgaatttgactatctttgtacgctgaatttaaccctattttataatcttattttatttatacggaaatgattttgtttttattgaacacgtctgccgctggaggtaaacttgaacaggcattggaaaaattggtggattttggtatggatgccggtaaggatatattaatcgctattttaatctatgtaatcgggcgtttcatcatcaaacagataagtgcattagtagccaggatacttgaaaaacggaagattgaaaccagtgtacagacctttttgaagagtctgataaagatactgctgaacatgattcttgcttttgccataatcggcaaactcggtgtggagaccaccagttttgcggcgttactcgcatctgccggtgtagctgtgggtatggcgctgtccggtaatctctcaaattttgccggtggactgattatacttattttcaaaccgtttaaagtaggtgactacatagacggtccgggagtaagtggtacgataaaggaaatacagatatttcacactatactttccactcttgataaccgcatgatttatgtacctaatggaagtctcagtggtaatgccgtcactaattacagtaagcaggacaagcgtcgtgttgaatgggtattcggtgttgaatacggtgaggatgtaaagagagtcagagccgttttacagcgcataatcaatgcagacagccgtatattggatacaccggctccccttattgtcttaggttcattgagtgcaagcagcatcgatattacagtccgtgtctgggtaaaaagtgtggactactggaatgtgctgtatgatatcaatgaaatagtttatactacatttaatgaagaaggaataggatttcccttcccgcagctcactctacatcacgcaaaagattgagcttattatctataacagtttccatttatcaagaatttgaagctttatgtttgctctgaaaagtatgctatactgttcattaattccgaaaaagaaatcataaactccttttgtttgcttttaaacattatcggttgctaatttattgaagctttatatatagatttgcaagtatttcttaattaggatatgatataaaaagattattttaactgtttcagcttttatagctgttagtggtgtttatgacaaaaaagcggtagaaggttttgacaagaataacaacctaatatttttttaatttgtaattatgatgaaaaaaagtttcttgactgttctatttgcgctgttctgcacgatgggatttgcgcaattgtctttcaatgtaaaggccggtcttaatctcagcagttacatcggtgaaaactctgaccattccaaatttaaaccaggagcacgcattggagtgggaatggaataccaattcagcgaccttgtttccttacagccctcgctattcttctcacagaaaggtgcgaaatattcaagtggatatagcggtagcgtcgtagatgcggatgcagatgtgaagatcaaccagctttatttggaattgcccatcaatgtacaattccgtttcaatattgcagacaatactaacctggtcattgcgacagggccgtatcttgcctgtggggtaggtggtaaagccaagttcgatggcaaggcatctgttggaggtatcaatatcaatggagatgagaaagtcgatacattcagtgatgacggcttgaattacaataggttcgatgccggttggaacatcggtcttggggtagagtttggccgaattcttgtgggggttgacacacagcttggcttctgcaagattatggatggggatgctccgcacaatgcgaatatcggtattactctggggtataaattttaaatagttcccttacgatcccttgattgagtatatttttattaatagtttaacttttttattgtagacaatctataaattattttatctgttttaaaataaaacggtgtagtatgaaaaaattattcattttattaggaactctttttttgttgtcagtaggtgcttatgcgcagaaagggaaacaagccataggtttcggtcttggttatggtacagaaattgaaagtatcggattgggaatcaagtatcagtataatataaccaatcctatgcgtatcgagccctctcttaattatttttttgaaaatgacaatgtaagcatgctggatgtgaacgtgaattttcattatctgtgtccggtagctagcaatgtcaagctttatccactgtttgggttgactttgtccaactggatgtttgatatgtatgatgttgactgggatggggatcatgttcatgtggatggcgatgggaatcataatgaatgtcgtttcggtgtaaacttgggagttggagccgaatttgcattgagccgtaattgggccatgaatcttgaatttaagtaccagttggtcagtgattttgatcagggtgtcatcaacatcggggctgcgtacagattttgaagaaaatatcggaacagaaatctcattgatataaaagaggggataggcatagtttaatgcttatcccctcttttttagtgtttcaatgcttggatttcaaagccaaatcaatcgtcatcatcatcatcatcgtcatcatcatcgtaatatcgatagtgcttcttgtggtgtctcttcggctttttgtatttatgtttcttatggtgaaatttgtcatggcgttcacagtatgaattataatattcataccagcagtcactatggtgatggactctgtcatagaaaggggtataatacacacttcccggatttatgccgatttccacaaggatacggttccatccgtaacgttgataccggttgtaataatcacagacgtcacgcatttttttcccggaagtcctggctatttcaagtgcaattcctacattcccccagtccttcccacagcgtctgtagtaatcgtccaaggaacggtttgaaatattgtattccagacataggcgctttctgtaatcagaaagttccacggctgcgtagcggttggctctgccaataaagatggaaatgccatcctgggcaggcaaggtgcaggccaataggagaaaaagcagtagtaaattaatctttttcataatgtttttaaattaggtggatctttactgtataaaattaggacggccttttttacaactcttattccagtttttcttttgctttttcaatttcatccccggcttcatccagggctttcctcacatcatctgctccctcctcaatctgttcttgtgcttcttcgagtgcgtcttcaacagattcctttacattttctacacgatccttaaccttgtcttttgcttttttctctctgcatgatgtaaagccaagtgcaattgtgcatgccaatatggcaaataaaaactttttcatattcttacatttagtgatattgtttgattagttaaaattcaaatgtagaaataaatattgtctttagcaaatggtggaaacatttttaaagataatgtaggagtaaaatatcttatttattggtacaatatgtaatgaaagtcttccaaataatcggataaattggagacaacttgcttttgagatgtagcctgtaatatgtacaaaaaaggctatctatcccagacagccaatctttttgttaaccttaatctaatactatgaaaaacacattgcaaaggtaaggttttgtggaagttatgcaaattatgagcctttgttcagccatcttataacatggtttagctggtaaatgtacttgttaaccattaacggtgtaattgttaaattgaaggttgggatttatttaaggtattgctggctaaagcaaaatcttctgccaaatcgtgtcagtaacttctttgatgccgaatagtccgttcgtggattattcggtatctttattttgtaaatcaaaataataaagtatgtacgcagtaaatcagtatgatgcagttgcagagagttatgattctctgttcaaagacaaagccagtattgaggagaatcgtaagattgcctcaatgctttttgaggtttcagggatttttctggatgtgggatgtggtacggggttactccttgatattctgaaagtgtctccggatgaatattggggtattgacccaagtagtaagatgcttgatgttttcagaaagaagcatccggagtataataatttgtgtattccgtttgagttgctcaatttaaagtttgcaacattcaatagcattgtagctttgttcggctcggccagttacattgatattgaagcactgacggatattcccgaaggaaagaatattttcctcatgttctacaaggagaattatcatccggtaacttataaacgtaccggctgtaatctggaacattacagtcattcaaggagtgagctggaggaaagatttcctcattgtgaagtaagggagtttgataactattatatcgtgacgaacgtatgatattgtattcagagcagaatgtatatgaagcggcaaaagaccggataaggaagttgttttctatgggggacagattaggtgtttgtttctccggaggcaaggatagtactgccttattacaccttactttggaagtgacaagtgaattgggcattcaaaagttgccggttatatttcttgatcaggaatgtgagtacacatatactgttgagtatatgcgttatgttatgtcattgccagaggtggaacctatttgggtgcaaattccgttccggttatggaatgcgaacagtggtgactggtttatcccttgggagccagggaaagtgtggatgcgtgagaaagaagatgtctcttttaaggaaaacgtctatggagtcgacagatttaaggatatgtttgatgccatcgcatatcatcacttgggaggggggtatatatctttgggaggtgtccgtattgaagagtcaccagctcgtcgtgctggattgacgggaaaggaaaccttgccaggaatgacatatggaaaacgttgtagccatggtgttgttatatatcctttgtatgattggtcatatcgcgatatatggtattacatcttctccaatcggttgaaatacaataaggtctacaactatatcttttcaaaggaaccgttgcgttctgcaagggtatcttctcttatccatgagaacagtaatcagaatattccttacttgcaagagattgacccgaaggcttataatgccatgtacatgcgtattcccaatattggcacaacgaaccatcttctgttggatgcctttgaagaggtaagaaactatcccaactgtttcaaggactggccggaatatctgcaatatctcatagacaatatcgtagctgagagcaagaataaagtaatttttaccaataatctaaatacggtggttgataagattgcgggctggtctgattccgatcgcgttgatatatatcgcgcctttgcccgtggtatcatcacagaggactttgaacagacaaagttgaataataggttattggttcataaatcaaagtataaatatggaaaaactaaaagaaataatcatccggatgcttgatgaagcgccagataaaataaacttcttcaatgagataagacagattttattctctctgtctcctgaaaaggccaatccggtggaccgtgtcctctgggtaccgatggatatggtgaaggcgaacaactataatccgaacgctgtggcaaagcaggagatgcagctcctttatacttccattcgtgaagatggatatacacagccaattgttacgatttggagtgaagaggagcaaaagtatattattgtcgacgggtttcatcgtaaccttatcgcgcgcatgtataaggacattgcccagcgcaatagtgggcgtcttcccattgttgtcattgacaaggatatcaacgaccgtatggcttctacggtccgtcacaatcgtgcccgtggcaagcattccgttgatggcatgacaaacatcatttataacatgataaaaaacggtgagtcggatgctgttatttgtagaaagcttggcatggagccgttggagcttgtgaagctgaagcatattaccggttttgccaagatgttcaggaattatgaatacagcaaagccatcaaagaaattgttcatcatacaaactcattggaattataactatggatatacagagcattgcaatagataggattattccgtattggaataatgcccggaacaatagtaaggctgttaagccggtagaagagtcaataaagaaatatggtttcaatcagccgcttgtgttggataagaattttgaaatcattgttggtcatacacggtattttgcccttttgaatcttggatataaagaggtcccgtgcatcattgtggacttggacgaggaaaaggcgcgtcagtatcgtatcgcagataataagacatcagaatttgcgtcatgggatgaagagaaactgatacgtgagcttaggacaatgaatgtacctgcagatatgcaagacttcttttttgaacccatagaccagttactcggttttgacatgaattttattccgacaaacaattatgtcacggaagagtcgcaatcagaagcggcaaaacaggaattcagtgaggaaatgcatcgccaagagaatgaatctttcaggaagaaggcagaacgtattgaagaaggtctggagcaggaaagaactgaatatattgaacttgcatgtcctcattgtggagagattatcagaatgaagaaataatatggcggcaccgacgggaaataaattttggatgttaaggagcaagcatgggagggataaactcttttccacgccagaactcttatgggaggcggcatgtgagtatttccaatggtgtgatgaaaatccctggttgtccaaaaaggccattcaaaagactgttccggtaaaaaggaaaaaagggaagaaggtggagacagtcaatgagcaacaagtacaacaagaagtttccccgacttcccgtccgtattccctaaccgggttctgtatttatgtaggtgcttcttccaagtggtggagcacttttcgttccgaatgtagaaataagaatgatgaagattttttggaggtcatcgcacgcgtggaggaaaccatcgaaacgcagcagtttgagggagcgtgcgttggagctttcaatgcgaatatcattgcccgaaagttagggcttgttgacaagcaggaggtggaccatacgaatgcaggaaaagagttcaaaggatttaattttctaccatatacagaagatgcggagaaagtcaagtaatgggatataaggtcaatataaagcagaggttagcctataactaccttcgtgacgatgttacgaagtttctgtgttatggtggcgctggtggaggtggaaaatcatggcttgggtgtgaatggcttatgcaatgtgcttactatctcccgggcactcgatggttcgctggccgaaataatttgaaagatagccgtgagtctatctctgtcactttcgacaaggtggcaaagtggcatcgattcactgactacaagcagaccaatgacggtatacttttagggaatgggtcggaaatcatctttcttgacttgacatattatcccgtcaaagacccgatgtatgagcgattgggctccaaggagtttactggaggatggattgaagaagccgggcaggttcactacctcgcatttgaggttttgaagacgcgtataggacggcacttgaatgatgtgtatggaatatccgggaagatacttatcacttgcaatccaaagaagaactggctttatcgtgagttctacaaaccgtggaaagaaggcaagctggaagccccatacgcttttattcaagcattggtgcaggataatccctacgctaccgaggattacatagatacgctccgcaataccagggacaaagtgacaaaggagcgcttgtactatggtaattgggagtatgacaacgacccgacagcactctgtgattatgatgctatttgtgacctattcgcaaatgagcacgtaaaaccgataggattatcgacgggagcagctgaccttgccatgaaaggacgcgaccgttttgtcggggggcactgggtgggtaatgtgtgttatatccggttagaccaggaatatagcacgggtaaatctattgagacggatcttaaaaacatgatgatacagtggaagattccacgtagtatgatggtagttgatagtgatggacttggaagctaccttgaaagttatttgaatggtatcaaagaatttcatggtggtacccgaccgattaatccagagtacgacaatctgaaatctgaatgtgcatttaagcttgcagagctaataaataatcggcagataagaattatatgtacggaagcgcaaagagagcgcataatggaagaattgtccgtcttgaagcaagaccatatagatgccgatacccggaagaaagggataatcagcaaggagaatatgaaagatatactcggacattctccggattacctcgacatgttgataatggcaatgctttttcgtataaaaccgatgcctaaaagaccaaaagcaaaattaggacagatatgacagtaaaagagtttttgatattgagtgacgtggcgagcaatgctactgaactgttggagcagataggaaagttgcctaaaccggactttgtcgcaggtgtcagagttccggagactctgaacgacctcaccataggtcagttgatggaactgcaatccgtacgcaatgtaatagactgtataatggttccatgttgtgttgtcctcggtttgcctattgataagatagagaagtatgaagcagcggatattttgggattctccacatgggtaaccagggaagttgaacgtattaccaagctctttgaaactacaagcgtggcaccgactccggaagaaagacgtgctggggttgataaactttcgttcgggttgtttggcttggtggattactatgctacccgcatggggataactgaccatgagcaggtagaatgtgttccatgggtgagggtatataaatgccttgacatggatgcagagaaaatacgctatgaacgtcgattacgggaaatatatcagaataagcaatgaatacaagtgtagaaaggaagatagcttctgttgcagaaaagctggaaggagtcacctatttgttcgataactgggcgaccgccaatgtcaggttggataagatgccattgccggccattataaatttgcttcctatatccgggaaattcgtcatatcaagaacacagctaagggattctcctaactgcatgatagcatttgctgataagaccaaatttgatttcgatggggtggagaatgaggaggtcattgagagatgcaaaggatatgcggttcagtttatccgtgagttgaataggagcgagctgtttgagtgggtgagcgatgaggtaccttattccgttttctatgataagctggatgtaaatgttaccggaatagtaatagaattgaaattgaaagaggttcaaggagcgcccatgtgctagttatggaagataggaggaaagaggtaaaggcgatattgtgtgaggagttggataatcttcggcagcgcatcatagaaaatcatatacgggctgggcaacgtgcaagtggcaaaactatcaagagcctgcacgttgtcgtggatgataatcatggtactctttatggtcgtcaagcgttcggagttctggaggtgggacgtgcctcggggaaagtaccgaaaggattctataagattattcagcaatggatgatagacaagggtatccaagtggagagaccaaggtcatttgcataccttgtggcccggaagatagcaacagagggcacatcactttatcactctggtacgtacgaggatatatatacaacggacgtggagcaaacaatacgggacattatggaccgtgtgtttggtatactcgttgatgatgtgacacatataaatctacatagtaatgagaactcataagataggggaaacaaccatagaatatccggatgaaatatctttctgttttaatccggtagtgataaacatttacgggcatgcttgggattacgtggaggtgacggtgactgatatcgtttctgaaatttcatacaaggagaagagggctctgtttaataatgcatgcttttttgatgtgtcgttttacatgcagtctacatttgacactgtagaattttggaaaattgattattcacagacgattccgaaagatagcggggtaggacgtgtgttctctgtagatattgacttttattcggacagttcaatgtctgaaagttttcaattcaatacgttcatcatttggggggcaatgaaggtgggtgaacggtataatggaaatcgtatattgacgtggtttaaaaaccttccgtttacggtaggaatgtatacggccggtaatgctaatgtgagtgtgaccgctgacagcatttctttaccagctattacattgtctgaaagaaaggtgtataatattactttgaatggaattgatgcaaacaatgaggtcgtattgaaattgccgggaacgagtgtgggggcaaacgtgttcgacaatacatttgattttacttttcatgcattgacgaatatggctgtaaacgtgaggcttttagttgatgaatgcacggatggaatttatttacgttggataaatcgtcatggcttttattgctattggttgtttaaacgtggtgatgagagtaaacaaattgccaatgatggtgaatttattcgtaataatatgcaagactataactatgttaatggctatcatggaggttcaggacgtaagcagagaaaaacagaagagaatacattgttggtgtgtgctcctttagtggactctgaaacgtttgacttcttgtttcaactcgcgttgtcacccatcgttgatatgtatgcaggtaaaaatgtgaatggagttgatagctggaaggcggtgaatgtatctgttggtaacttcaataagacaagagccgtattgcaggatttcgtagcaacaatcatattaccagaaacaagagtacaaagcttatgagaaatgacatgctatttattgatggtaagttggtagacttggacgataataccaagattacacttaatttcaagagcaatatttttacagacttgagtaagattgtgagcaataatagttatacaatcaaattacctaagacaataaggaatcaacgtatcatatcgcatgctgagcttccatctgcagactccggttatcctcggaaatatcatgatgcaagatattttcgtaatggggtagaggttattccaactgctaaggctgtacttatatctatatctgataagattgagattgccatgacgtggggaaatataacagcactatcatcaatgcttgaaagtggaaaaagcctgagagatatggatgctggtgaatatgtgggaggtatatattatccgaaatatattgaatggaaagattggggagaaaatgatcgtgtatatccaaaggttgactatggtttcagaaatggagattcaatggtgtggtatcatcctgttcagtctgtaaaacaaatcatggaatacatagaagaggataacggcatatcttttatttttccaaaagacaaagaggctttattggaaaacatgtttgttccattattggaaaaaaatccaagcgaagagtatgcagaaatcgaagctataaccgttgatttaaagggcgttgcagaggatagggctggcaagacaaacatatacttcaacgatatgggaaatgttggttcgttttatggaaaccttgcagtaataggaaacggagtgagtggaggatattacaatggctataggtctaaagtcataaatgctgtacctaagatatcgggtaattttaaagttaaagtaaatacaaatgtggctccattatctgctacattggaagtttataattacaacttcaatgaagtcggtagcgaactggatacaagtactgtacttacaattccattactgaatgtaaattttataagtgacggtgtatatgaggtcttgtttcaatttgagaataggcaaacagagatgctttctactctacattcttctattcctcatctgaaatttgctttgcagaatataggcaagccatctgatgtcgtttctattagcggcacgttgaagataacgaatatagagcaagaaatattattgggtggtagatattggataatacctaatctgccagatataaagcagtctgattttattaaagctatatcggcaatcataggtactttccctttgttcacagaaagtaacggccttgtgtttgtatcatttgatacaattatgtctaataaggcgaaagcgttggattggacccgtaggctggttgctacatataaagataataaacctaatgcgattgcctattctcttgatgatttttctcaaaagaatttttatagatggaaggaggatgatacggtagtggggaaatatgatgggtatttgtttgtagaaaacgaaacgatagaaagtgaaagagatgttgtagaattgccgtttgctgccagtgaccaattctcggatgtagccaagataccaatatattcatatgatgaggaaggtaatttggaatacaattcagttgagccaagattattggcttataatggtgtgaaaggggtatttactggtcttgattggaatacactcctttctatgtattaccaaacataccaatctatcatacgaaggcctattgttattacagaaaagatagaaataaatgatattgagttgagagacttggatatgactgttccaatttatttggcccaatatggtagatattatgccattatttccattaaggcagaagatacgggaatatgtgaatgtaaattgttacaattggaggtgtagttatgggaaatagcaatgtagaagaaaagattcttaatattagagtacgttatgatgatgctattcgtaaaatagcggagtatcgttcacagttggatgtactccgaaaaagggagcaaactttaaaggatgacttgaaggctgggcggattagtcgagaacaatataatttgaaattgtctgaaacgaagatagcaacgcagcaatataatgatgctattcggatgctgaataagcaagttcagaatcaattaaaattagagaaggaacaagagggtagccttgtggctttacgagcagaactttccaatgctaccgctgcatatgacgcattgagtagagaagaaagagaaggtactaaaggtaaagaactgcagaatcatattaatgcaatcaccgaggagttaaaggaagcagaggaggaaacgcagcgtttttatcggaatgtaggaaactatgaagctgctattttaaaggctgcacaatcaaatatcccatttcttgattcaattattaaaatgcaaacagaacttggaggagtgaaacaagcttttaatgttgggaaaacagctgttataggatttagtaagcaattattagctttactgacgaatccgatagttgctattcttgctagtattgctgcagcgataatgcttgtatccaaagctataaattccagtgaagaagcgtcaaatcgttggaacattattactgctccattatcaaggtcacttgattttcttttgaacatagttcaacgattggcgggaggtattctatctgttgtcgagtctggagcaaagatgattggatggatagctaagatggcagaaaaattgcctggcataggaaagtatatcagggacattaacgatgccaatagagaggctatcaaactggctaaggaagaagcagccatagcaaaacaagcgcgaacggaccaagtacagaatgctaaagaccagctggaggtcgcacgtttgcgccagcaggcgaaagacaaggagaagttcacggcagaggagagacttgctttcgtaaagcaggctaataagcttgaagaggagcaggcaaagcggaatgtggatttggcaacgagagagtttgagcttcttcgtaagcgttcagaatgggcagaaaatgatgcagagacaaatgataagttggctgaacttgaagctgcaaaatacaatgcggagaaggagtatttctctaaaactatggaattacttgagcaggagaatacgattagaggagaaatagtcacagtgcagaaagctgtggcagagaaagtggctgccatcaaagaaaaagagcgcgaggaaatccgaaaagcagaagatgaagccttgaagatagtcaaggatgcccaagaaaaacaatttattgagactaagagagtgtatgagcgtcagatagaggatttacgtatccgtttacgtactgaaataggtcttacagcaactatgcgccaagcactcaatcagcagatcattgcacttgaacagcaaaaaaatgatgcattacagcaattatcggaagaacaactgatgaaggaggtggagaaccggcagaaactaatctctctgcaacttgaatccgtaaaagctggaggtgagcaggagtaccaactaaagatgcagcaacttgttgcccaacgtgacgtagaactccgtcagaaagagcttactgaacagatgaagcttgctattacggagaagtacaataaagagatttatgatttgtccgttcaacatgagaatgatacagcaaagaaacaagctgatgcactcaaacttcgattggataatgaattggcagaagctaaattgaatggagatagtgaacttgagcttcttcgtatgcaggaacagcagaagcttgaactgaaagacagcttgagacggatgggagaggagagtgatgccgaattccgggccaggcagcttgctgcagaccaagaatacttgaatgcaaagcaggcggtcattgacaaggaagtggagatgcagcaaaataaaggtgaatccctttctgtcttggcagggaatctttctgatttgttggaacaagcggcaggagataacgagaatatggctcagttggcgaaaatactggctattgcggaggtttctattgcgcaaggggtagccattgccaaagccgtagaaacagctacccgctcatctgcaacatggattgacatgcttgctgcgataggtactgtagtggcatctgtaactactgttatgggaaaggctatgaaatcggtgaaaagtgctaaatttgcacaaggaggtaaagttgaagggccaggttccggtacaagcgattccatacctgctatgttgtccaacggtgaaagtgtaatgacggctgctgcaacctcgatgtttgctccgttattgtcggctttcaatcagataggaggaggtattcccattaatgtaacagcttcttccaatcaggcgttaggagaggacatgctggccaaagctgttgcaaaaggtatgatgatggcgcctgctccggtggtttctgtggaagagtttacctctgttgctaatagggttaagtacgttgaaaatcttggtagtatatgaaagcatatgaactattgatattgaataaaagtcttcttcaaatgatgggggacgcttcgcttgatgtcggggatgtgaaatatattcccgtgtatcaagagtatgtccgtctgtcaaaggaggggcataaaaagacttatatcatgcaatatttatccgatgagtataatattgcggaaaggacaatttatcggataatagataagttctcaagtaaagtggatatttaggggcggaattattccgccctttttttgttttgaaaaagttgctgacaaagcgtgtcagtggaatagacttcttattttcttcaagccgtatcatgttttctacctttgttacaaacaattatgtgatatggctaaattatacattaacaaggacattgtagccgataaggataaaatggaaaattggtatttgaccggtgacgaggggctttcgtttccggatatccaatacttcctttcatggcttgacccggctgaccctaaaattgacattgaaatccattcgtgtggcggtgatacagttgaggggtatgctatttatgatgcattacgtgcgtcaggtaaggaaatatcttgtaccgttgttggacgatgtgcttctatggctaccatcattttgctttctgctccacttgaacgcagaaaagcttatcctcatgcaaagtttctcatccacaaaccatatttggcaagatatgatgatttattggaccttgaaactatagaatccatcaaatcaagtctggaagcggaaaaggataagatgatggctgtatatgttgaacggacaggagttgaatcgaccattttggaggtccagatgaacaaggaggcatggtttggcggtgaggttgcaaaacaacttggatttatatctgatgttcttataccaactacagcaaaaggaactgattataaacttaatagtgagaaaatgaacaaagaaaaacaagtaacggtaaagcaatctatcattgacagactgcttgcgaaatgtggctaccagaagatagaagacattccggtagtatctatggaactgacagatgccgaaggtaatacactgacggtggaacgtgaagaaggagaaccgcaagtgggagatgcggcatcccccgatggcgagcatgttatgcccgatggtaagactatcattgtaacagacggagtgattacagaaatcaaagacccggaagaaacaaacggtgatgaggagattgaagctttaaaggcgcgcattgaagaacttgaagaggaaaatgcggcattgaaaaccaatgcccgtacagttgaggacaataagatactgaatgctgtaaagatggcagggggtgagaattggctagcaaaacattgttcaacctatagagtctctttgcgtacccaatccttcaagaatactgttgagacacaagcaagtgcagaggagacacctattcaaagaaaattgagagaggaaagggagaagagagctaaaaagtaaagaaaggagaattgagtatgcctattttagatttttcaaaattgacgccagacaatcaggcggtgaaagatttgaaagacttgattgaactgacagtctttcaaaatgaggatatggagcgttttatgacgttcatgcctaaagtgaccaatggcaagaaagttggtttcatcggtgagatggaggatgtaggtatcgcaggcgccggatgtgaccctgaatatcaaaaagtggctatcgctgccgcccagaaagtatgggaaattggtgactggcaagtcccgttggaaatgtgctatgaggacttggagaatactattgcaaagtactgcttgaagacgggtaccaatattgcggaccttacttctactgaatatatggatgggattgtccttccaaaactgacggaagcaatgatgaaaatgttatggcgcttcacttggtttggagacaaggatgccgctaatattgacggttccggtcaaattacggatggattgaatgtagaattgttcaagacatgtgacggtttctttaaacgcctgtttgccatatgtgcagagaattccggtcagcataccgttatatcagccaactctgaaacatcttatgctttgcagaagtccaagatgaaagaattgggggctgctacatctgtgtttgacgcgatgcttgaagatgcggatagccgtattttccagaagtccggacatgcaatttttgctacaaaatcattatgtgattctttgtcacgtgatgtgagggagaaatataaggttattatgccttggacggtcatttttgacggccttgaagtaggagagtatgacggcgttacggtcgtaaaatgttctatttgggatagatttattcaagcgtatcagaacgataaaacgaaactgaaccttcctcaccgtgcggttctatgttctccggacaatttaatgtacggttgtgaaggcgataacccgatatctgaccttgatatctggtttgaaagaaaaccccgtaagaattatatctattctactggtaaactcggttctatgattggcgaggacaacttggtgcaagtagcatattgacaaaaggaggtattctatgggagtatgtgatgatattttaaagaaagatattgttccgtcgtgtgatgatccagtagtacaaggattggagcaggaaggggtaataatgaatcgtgcggatgtggactttgcagccacagtattcaattctacaaaaaagaatgtgattgaaacgctggctatgaaaaccgggaagaaggcttataaggttgttgttcctggtaaaaatccatttacgggtacaaagacctcattagtggctggcacatatcgtagttcgtttaccaatactgtcgcgattgtgatattggcaaacgacccggatgtatgcgctgatgttattgacggattggctaacggtacctatgttgtggtgttggagaataaatataagggtttacagaaagaaggaaaccctggtgatgccgcttttcaggtgtatggttactaccaagggcttacagctacagctatcgacaacgataagtatagcgaggatactgaaggtggatgggctgttaccttggaagagcagaaaacgcctaaatctgcattattcttgttcaagacgagttatgaagcaactaagactgctgtcaacactttgacggctgaaccggcagcataggagggaatatgcttgtcttggagatggttgataagttgaagagattgggggataaggtctccctttcttcttctgataaatcagacattgaactgatgtttcatgaagttcttggtaggacatttaccaagacctcatgtggtgattgctatcgtgacgctgtgattgaaatgtattcgtacttaaaaagatatggaaaaatgaaagaaaaatcaagttatgcattgaaaaatggtgtattgctccaagtaggctttggaagtagtgaaatgtacaccaacaacaatcttactgacgaagcggcagaaaggtatcttgcggaaaatcctaaagggatagtcttttttgcttcaacgccttccgattgggagaaaagggttgaaagacggatgagtcctgctttaccattggatgaaactttggtttcagaattggtgaaagcctttgaagtggaaggtgctacttctgagattgtgagagatgcgttcaagacttataaactgaacgggaagaaagttacagctaaagtattggatgctcatattaaagaggctcaatctgtagttgactctaagcagactatagaagccgtagaaacggtgaaataaagaataacctcacggaacgatgaatgtaaatgaattaaagaagaagagtaataggcgtgttgacacgggctatttacgtaatcttggcatccaaagctacggtgatgataatttatatccccaacatctaagaaatatcatcgctgcgagttcaacgggtagcgaatgtgcagaacgttatgccaatttcatagagggaaatgggtttcgtgaggttgctttttctgaatatgtggttaaccgccgtggagatacggcagatgacatccatgctttcgtctgcaaggatgttgctgattacgatgggatggcgatacatgttaattataatatgttcgcagatatagtggaagtacagcacatcccctttgaaaattgccgtttgttggaggaggatgaatccggatatatcgcaaaaatcgcagttcatccggattggacaggaaagaaaacccgtcagggaaaagccataaaggtaataccagaaaatgtggagtttatagatgtatttaatccacgtaaggaggtggtctatgcgcaaattcgggctgccggagggattgaaaactataaggggcagatactatggattagcaacacagggaaattcgtgtatcctatcggaagagctgaccgtgtgattacggaaatgagtacggatgagggattagccaatgtgaagtatcgtaatgtgcgttgtaacttcatgccttccgggatgataattacaaagaaaggtgcttcttcggtacgttttgatgaaaacggaaatcctataaaagaggataggactaatgaagatactggtttttctgatactatcgtgcaattacaaggagacaccaatgcgacaaaggtcttagaggtaaccttggaatctgatgaagaaaaaccggagtttgtggatattagtcctaaaaattatgataaggagtttaccgttactgatgccagtgtggttgaacgtatttattcggctttcgggcaggagccttggtattgtatccggattggtaaggttggtttttctggggatatattggaagatgcttttgaatactataactctattgtgtcaaagcaacaacgcatgattgaacgggcttttcagaaaatttttgcgcattggtatgaacctctcaatccttccaatgactttagtgtacaacctcttaaatatataagaaatgctgcgatgtctaataacaacagatgaggtctataagttggctcgtacgatgtcaatacacatcgatacggaaaagatagaggcatatattcgggagtcggagaacattgatttgaagtcagctttgggtgatgctttattcttagatgtgaaagaacatccggaaaattatagtgagttgcttaatggtagttcttataccatagaatgtggaggcaaacgttcctttgtagggctgaaaacgacattagcatattatacctatgctcgtatcgtgaaaaatggagatggaaatgtcacccgttttggatttgtcaataaagataacgagtattcgtcgcgttctgattttaaggagaaacttatggcttataatgatgctttctctgttgctgataggtatatgaaagaatgtgttcggtatttgaatgataacaaaaaagactttccgctgtataggggaaatggagggattaatgctaatcgtgtaacttttagagtacttggtgaataatgcctgatacacttgacatattaaggaaacttgctctacagataaggaacgcctcttctgagggagagaataccgcagagagggttggacggacatttattggcattcttgaactcattcaacaaggaatgagcatcgaagaattatcaaaggtgttccttcgcaaagaccagtctgacggcacaaattttctgttgaagttcggcgagtttatcgactctatggtcgccactgccgtattcttttctttccacagctgtggaaagaaaagaatacggcagtggaaagattagcatctaggatagaaaaggataactcccaatgggtctgtctttagttcttggcaggcaaagaaacagaagcctccaatatcggggagacagactcccaaacctgagcatcaatactctgcattccttgcacagaaggatgcccccattgtttatcaatgtcgtgcaaacgaatattctcgatgccatagtgccggcaaatttcatccatggaatcagttacctcttcggataattcagaattggtaatattataaatcctggccgcaggatagagctgcttgagagatgcaagcagatagcaaaaggcaggacggaagctatacaaatcggctttcgtccagccatcatattggtatgcgccaatgggggcacctgcccagctgtcattggtaccgccaaaaacaaggattatgtcgggggtgccgaggttgtgaatacgggtgataaaagaacggtcggagtaatcggctttctcgtaaccggtatgacagacggtggagccggaataggaattgttgcgttccaactgaaagccgtgctcatggatgaaacggtaccaccaggtttcctccacctttgtcacatcattctctttcttttcgccgggaactccataccagcagagattggcggcaggagagacatgaccgtaaaaagtggaataggaatcgccaagaatagaaactttcttttgagcaaacacccctgatataaggggcagggagaaaatagccagaaaaaacaaggatttgcagttcataatcaatagatttttatgtcgtatgccgcaaagttataaagtttgtcccggtttgacggcaggagaccgtagtttttttgccatagcccgcttatatgaaagttcctctaccgccggatttccacaaaaaaggaaatgccggattgatagaggagcaagagaatgaagatgagaaagagtatattttactcccgccctccaccgagggcttgatagaggttgatgataccttgtatttcatcaaagcggtgggctacctgtgtcagttaggcagagagtagcccctgctgggcagtgagcacttccagataggtggaggtgccgtgccgcatcagtaaccgggtgctgcggacggtagtttccagtgaagttatctgccttgtgcagagctccgtctttccacgggctacctgcacttgggtcagagcattgttcacttcgctgccgacattaagcaaaacttgctgaaaagcgagcctggcttcttcctgctgtgctttggcatcttgagctgtgccacgttcagccctttgttgaacaagggttgtgtcagcgagtcgatgacagacagaagaagttttccgggattgacaatcatgcttcctgccgagttggtccagccagctgtaccgctcagggtgatggaggggtagaaagcagaacgggcggcatttcccttacctgctgccggaggtcgagcagcgaagcttccacctgggcgacagttggcttcggattgcgaaacactcgcctcgttcgtcatgcctgcagccatcatggctcgcatggtgcgtgcactttcgcgccaactggcggctgtttcttcggaaatgcggtattgctcgtcaagtatcagcaaggtaaaggttggccacatagctatcagcgaagtgctgacggcttgttcgtactccaaactttgaaggtagagcgctttggagcagcgcatggcactggtcaaattagcccaaatatcgactctccaacttgccgaggcaataccggaataggtccacgaacctttggaattgtcgaaactgctgacgccacactgcggagtgagcataaacgaagacaggtacgaaagtttggccgacatcagcgtggcttctgcctccctgatgcattgctgggcggaaagcaagtcggtgttgccttgcaagatttgctcgatgagcgactataattgcgtgtccgtaaaaagctcgagccaggaaagggaggcgatggagacagtgtccgatgccgcaaacagactcaggctatccaaactttgcccgtccaaatcgtgttcataaagtccatcggttgtgatgtcctccgggcgctggtatttggtatagatgccgcaactggtcagtaccaagccggcgacagctaatactgaaagagattgccgacaaataccgttttcccgaccagttttttttcggacgatatttcaagaaacacacgagaatgtcacccaaggagtatagagcaaagagaactgaagcataagcatacataaatcccccttatcctctacctctttagtattttttgcgtatatttgtcagacactaatttaatcaattcaatgccatgagaaaacttacacacatgctccttgcaggtaccctcgtcctggcctgctcttcatgcggggtagaaacaacagccaactatcaagtcatccccctgccccaggaagttgccttgagtcaggaatctcccttcaacctgaatgccggtaccatcatcgcctaccccgaaaacaatgaacttttgaaacgtaatgctaagtttctggctgaatacatcagccagtccaccggccacaccctccagacagaagcccttgccccggggagcgaagcgcccaaaggcgccatcacattaggactggatccggctatccgcaaccgggaaggctatgtgctgaccgtcaaagccgaccgggtgaccctaaacggccagaccgagaacggagtgttctacggtatacaaaccctgcgtaaatcaatccctgccgaaaccaaagccacctctatcctattgcctgccggcagcatccaggatgaaccccgcttcagctaccgaggcatgcacctcgatgtgggccgccacttcttccccattgagttcatcaagaaatacatagatttactggcacttcacaatatgaatacctttcactggcacctcaccgaagaccaaggctggagaatagaaataaagaaatatcccaagctgacggaaattggcgcctggcgcgaccgtaccgtcatcggccggaataccgaagagtatgacaatacccgatatggcggtttctatacgcaggaacaagccaaggaaatcgtaaaatatgccgaggagcgctatatcacggtcatccccgaagtagacctgcccggacacatgcttgccgcactggccgcctatcccgaaatgggatgcaccggtggaccgtatgaagtgtgtccacgttggggagtattcgaagatgtgctgtgcatcggcaacgaaaagtccatgcagttcctcgaagatgtcatggccgaaatcattgacatattcccttccaaatacatccacatcggcggtgacgaagctccccgcacccgttgggaaaagtgtcccaaatgccaggcgcgtatcagaaccgaaaaattgaaatccgacaagaaccatacagccgaagaccgtctgcagagttattgcatgacacgtatcgaaaagttcctcaatagtaaaggacgccggattatcggctgggatgagattctggaaggcgacgtcgctcctaacgcaactgttatgtcatggcgtggctcggcaggaggaatcaaagcggcccaactgggacacgacgtgataatgacacccaacgactattgctactttgattattaccaaagtgaggatacccggcacgaaccatttgccatcggaggctttgtcccattggaaaaagtatacagtctgaatcctaccgcctcactgaccgaagaacaagccaagcacatactcggcgcacaagccaacctttggacagaatacatcccgaccagcgagcaggtagagtatatggttctcccccgtatggccgcccttgccgaagtacaatggacacaacaggaaaagaaagattatacaaacttcactacccgactggccggactcatcagcctctaccggagagacgggctcaactaccgggaacccttccgacagcaggcagactccactgctaccgagaagaagtaatcagaactggaaataaataaacggctgtatctccgaacttttcatctgaatgaccagatagattacagcaagcaccagtaccgcctttcccaacaagggaaggcggattactgtttttgtgcaggcacgttcccaactgtcgggcacaaaatgcagaaaatatcccaatgccatcaatgcgaacacttcccaatagcctgccaccaactgcgggaagagttgcggacggaaagtagtgaatatctgcctcagcatatccattgatgtggaaaactccgcattacggaagaatatccagcagaaacaaacaaaatggaaagtaataagcaccccgaagaaccggcgaatgccacggctttccgcacctttcttatgtccggtgagcgtcatccagcacttgtgggctgcaagcgcaacaccgtgcgtcatcccccaaaggacaaaattccacgaagctccatgccacaagccacccaggaacatggtaatgatgagattggcgtactggcggattttccccttccggttgcctcccaaagagatataaagatagtcgcgcaaccaactggaaagcgagatgtgccaccgcctccagaactccgtaatggaagcggacttatagggagaatcgaagttgatattgaaatggaaacccagcaacaaggcaatgccaatagccatatcactgtaaccggagaagtcgcaataaatctgcaaggcatagccatagacacccatcagattctccacccccgaataaagagtaggattatcaaagatacgctctacgaagttgacgctgatatagtccgatatgaccgctttcttgaagagtccactcacgatgaggaagattccacgcccgaacatctccctggagacaaacagtggacggcggatttgcggaatgaaatcacgggcacgtacaataggccccgccaccaactggggaaagaaggaaacataaaaagcataatccaataaactgcccagaggcgttatctggcgacgatacacatctatcgtatagctcaacgactgaaaagtgaaaaaagagatgcccaccggaaggaaaatatccattgccgtgaacgttcctcccgtcagcgaggcaaaagtttcgcccaggaaattggtgtacttgaagtaacacaacaatcccaaattgatgaacagactcaacacaacccatgccttacgtagccagggaatagcctcgcgtgccatcaaacgtgcaatgaaaaagtcacagaccgtcaccagtccaagcaggaaaaaataagtgccactacttttataatagaagtaataggaaaacaaggtgacaaacagcaaacgcgccgtcgtccggcgttgcaacaacagataaaccaatataaaagcgacaaacagccagaggaaaataccactgctgaatatcatcggggcttgcgggtcataagtgaagacatcgcgcaaacggtccaagtctatattcaatccggataaaaattcttcaatattccacataatcgttataagcttttaacaaggcctggcagaacagctcgccttgcaggcggtaaccgtccggcaaataatgtacatggtccggacgcatcaatccggcttcctgccagttgaggcaggcacggtgggtaccgccaagtatttcgtacatgtcccataccgccaatccgttttcatcggcatagcggcgaatggtctgcacggcaacggcagtacgcggattaatcttataggtccgacgacggcgacgctgccggaaactctcgtaagagcccggaggagtggtcatcaacatcggtacattcggcagtttctcgcgaagcatgcgtacaaggtcatccatctggcgatagtgcaacattgtattgtaacggcggttatggctttcgttcgtcccgaaggaaagaataagcaggtcgggatgtagagccgcaatatcagcaatacggtccggacgggtgaaagtagtacaaaatgcaccgttgatacctacatcggtataagagactgccccgaaagtgtcctgcatcaacgcaccggtggtacgggggaagatatggccgcgtatatggctgtcgcccacatgtacgatgcgaagcgtatcagcggaagcgcccagccgggacagacgcaacttctcccagaaaggattaagaatacccagactgtcggtaagtacattctccttcatttgccggaatgcggcgggaaaagttatcaaagggacagacaccgtatccgtacgttgggaatagaggcagagagtatcacaatccgctccaccggtatgacacgaaaggctgcctggcagtatgtcttgtgcatggagcggccgtatcgccgcaatcagtaccagcaccgcgcagcaaatcatacatcgtaaatcgtacaatcgtaaatcctccttatggctcctcttcatagtaggccctccttctgtcatactgttccttgccataaatcaaagactcataaagtaatcccgcaagatgctttccaccacggaagttgatgtgcgtataatcataattggccagtgacggcttggcatgcaccatgtctgccatgctgccttccccacccatggcctcgaacatgttccagaaagcgacagcctcatccgctgccagattctgctgataacgaaccagattcttgatgccaggcatggtacgcagctctccttcttcggtcttatagtccctatcgcccacgctgactatgaggatggctgcttgcggaaaggcctccttgagatgctgcaccgttgtctgcatgccggcaatgtacttgtcgtaattccgtccgcgctctgtagccacattcagtccgtactgcaggattatcaaatcgtaaggacgctgttcgttgaactcgcgcatcatccacacgggaacagaacggagggagaggccggagctgccacgcagtgagaagttatccagcacaatgccggaagtaccgtccatggcaaggccataaaacaaggtggagtccgcactttccaccgtccaacggacagaaccgatatttccctctaccgtcatctcctgcaaatcatcaatcggctcaaaagtctcagtagttgcttcgccacgattgacgcggacagaaagggtggttgtgccacggttatagaaaaaaatactggcacgctggcaggtgtccagacgggaggcatagttcttctgcccccgcagttccacataagcaccggtattcggaataaagtaatgtccggagactcccagcttgctacggtcaaagaacacggagtccatgacagaatgactctcccatccgctgaaggaatgacgcactgtagggcggaagccactggtcatggacgtaatggtgacaaaacctactccgcaaccgccatatttctgctgaagcatctcgcgtaaatcagccgtcagaatatccgcttcgataaaggagtcgccgaagtaggcgatacgaaccggacggggtgctttggcaagctcgtcgagtgcctgatagaaccgcgtcatgccacgcatggtagaatcactataatcttcaatgcacgtcatgcccgcacggcaggtgtccacaaaggcgggcttcaccttcgggggcggaggcagcaggctgtccggctcactcaccggcttggaaggacgacgcacgtcccccaagatatccacacgcctcagcacacggccacccatcgtaatacttggcaacagatgcatcagcaacaatgcaccccatacgataaacgccaacagacccgtatatttcaatgaattcttttccatacctaatgtggacgcaaagatatagatataggttgaaaaatctctccggacaaaaaagaattatccccgaagaaacaagattttttctccggggataacggttatagacagagcagacccgattaaatggtctgttcgatattccaaacaaaagcacggagtccgagttgctcggtctccttgtccatccgatggagcgcttcgagcagcggagccaccttagcctcatctatgatagtgatgatggcggaacacatactgggccaggcatggctgccatagtgcggttctcccgtcttactgccacgcccctgtacttgctgccaatagctgaagccgcggcagttgtgacgatcaagcaatgccatgatacgttcaaagaacgcttggtcgaatgttataaatactgatttcacgctatataatgtttagtgattaatgtttaatgattaacggataatgattaatcattgtttacgtggtttcgtcatcttctccttatgcaactggtaataatcattcagctcacggtctttcttaatcttcttacgtgtgcgccgaataccaacacctgcaaacgagcaatagagtacagggacaagaatcaatgtcagaatggtagataccgtcagaccgccaattacggcaacccccaacggacgccacatctcggcaccttcaccctgccctacagccatcggcaccataccgaggatagtggtcagtgtagtcattaataccggacgcaaacggctgcggcctgccgtgactacagagtgaagcaccgcttgaccacgttcgcggcaaagcgtgatgtagtcgatgagtacgataccgttcttcaccacaataccaatcaacatgattccacccaaaagcgacatcacattcaaattggttcccgtaaagaataatgccatcaacacaccgctgaatgcaaatggaatggaaaacatgatgatgaacggataactcaaagactcaaactgagctgccatcacaatgaatacgagaataacaatcaatacagccagcgttcccaagtcggagaatgaatcctgttggtcctcatacgaacccgaaatctggatagaaacaccacttggtaggtccatcttatcaattatagcattaccatcggccaccacatcgcccaaaggtgctcccgaaataaccgcagatacagtaacaatacgctcacggtctttacgttcgatggtaggaggagcagaacgctcgactactttgccgaggtctttcacgcggataccctcaccggaaggcgtataaataaggatgttctccaaatcttcaatctttgtacggaattcgggagcgtaacgcacacggatgtcgtactcgtcaccatcttcgcgataataagatgccaaagcaccatttacacgattacgcagatagttggaggcagtagaaagattcaagccatgcaatgccagcttctcacggtcaaagtccacctgatattcgggctgataatcctgacggctgatattcacttcactcacacctttcacctgcaacaatttctctttcagttcggctgacactttgtccgtcgcggtgaagtcgtaaccataaacctcaaagtcggcacttgcctgggcgctcatgccgcctgtgctaccgcccagaataacctgcgccttgtccaattcgggataccccttcaagtcctcacgcatttcgtcgcaaacggtttccagtgtcacgtcacggtctcccggactcaccagactgatattgaaactaatgatatgactaccgttgtcctgcatggaagcaaacgtattgtcagagtccgcctgccccacagtgtagttgcaaactttcatcatatctccgtagcgcgtcatccacttgtttgtcagttccgaagccaacgcttccgcacgttccacacgggccccgatgggcaactgaaggttgataccgatgcggctattgtctgctgccgggaagaactcggtacctatgtacttggcacagaacagacttgccacaaaaaatgcggcacagcctgccataaccgtcagacgatggcgcacagcccagttcaaccggttctggtaccacacgtcaagaccgtccagcgcacgctgaatcggcgtatagagcgtaaggaacatcttactctgctttttctgcaaacgcagaagctgcgcacacatcatcggagtgaatgacaaggctgaaactgtggaaaccgtcataatcacacacatcatccatcccaactgacggaatagcacaccggacatgccacttaccatcgtcaatgggaagaataccgcaatcatagtcagcgtagatgcaattacggagatggccacctcgttcgtggcatgtatcgctgcctgcttcggttcggaaccccgttcaatatgggtcgttacattctcgagtaccacaatggcgtcgtccaccacgttaccaatagcaatggagagacaagagagcgagatgatattcagtgaaccgccgtcgatgatacccagatagatgaacgaggcaaccaatgacatcggtatggtgatacaaataatgaccgtggcacgccaacgccccaaaaaaacgaacaccaccaagataacgaacagcatagcgtacataatggtttcctccaagctgtctatcgtattcagaatattttcggaagtattgacaatgatccccagcttcacatcgctcggcagtgacttctgcaactgcggcaacatatcaattatcttctgcgaaatggctacagaattggcacccgattgtttctgcaccacaatcatggcgccctgcacaccgttgctatacgtcttctgtgcacgttcctccacagagtccacaacttttgccacatcgcgcagatagacggaagcaccgttatgcgtacctaccacgatgttctccatctctttgggatccttgaactcaccttccacacgcagcgaataggtattgttacccacatcgaacgtaccgcccggcgtattccggttttcggcactgataatagagctgatagtttctactgagaggctgtaggcatccaatttattggggtcgcaatatacattgacctcacgtttgggggcacccgaaatagacaccgtacccacacctggcacacgcgccaagggattcgccacgttgtcatccaatattttataaagagccggctggctctcctctgcctgcacggagagcagcaggataggaatcatatccgtactgaacttgaagatgatgggagtttcgacctcatcgggcagcatggagctcaccatgtccagtttatcacgcacgtcgttcgtcagcacgtctatgtcatatccatactcaaactccagcgtaattacagaaatattctccgacgaacgggaggtgatatgcttcagattactgaccgagttcagcacgttttccaacggacgagtcacgttgttctcaatgtccgaggcactggcaccctgataggtagtcatcaccataatggtgttggtctcgatatccggataaaggtctaccggcaatttcgacagagagaacagaccaaatatagccactgccaggaagcagagcgaggtcataatcggtttcttaaccgctccttcgtataaactcataagattaattctttaatttgtcaatgtgctaatatgctaattggctgcgcaatgtagctacattggcacattagcatattatcacattatcacattagcatattatcacattaccacattaccatattatttttctacctcgacttccacaccatcggctaatttagactgcccggcaataacaacttgagagttattgtctacaccggaaatcaactcatactccgtatccatacgacggccaagttctaccttattataagacaccttgccgtccttgtagacatagacatagcggtcgcctgaaccggcacgcttcacaatggccaggtcgggaacgaccacgtggtcccgtattccgaaattcagcgtggcacgggcaaacattcccggacgtacacgctggtcacggttaacaagctgtatctctaccgggaaagtacgggtagccgggttgatggtaggataaacaaggctgattttgccttcgaactcctcgtcaccatagacatccactttcacagatacgggagcgcccttcttcactttggtaaagtagccttcggatacgttgatgtatagttttaccggagtgatttgctccactaccagtaccggctctccaccgccatacatatctccgttatcgtaattacgtgccgtcaccactccattaatgggactgagcaacgaggtgttctccaagagattcttataggaagtctcacggatgtcgagattcatcttggcggcatcccactccgacttggaggcaccacctaccttatacaactcgtcaatacgcttgaactctatctgctggttgtccagctgatattttatctgcttcagattggcagcatccatgctgaccagcttctggcctttcgacacgcggtcgcccacctccacaaaaatgcggtctatacgcaccggagaagagggagcaatattgtttttcacttcggcttccaccgtagcggtgtattcctgaatctgttctacgggacgggacgacacctcggccagtttcaccttcggtttctcgtccaccttctcagcagcagctttatcactacctccgctacatgcccccagcatggcaaccaccagcaggaccatccattgaaaaccttttttcatatcgttgtttttatttctattcttcattcttagttcttcattcttcgttccctgcaatataatcctttcccaggacttggtcaaggtcagccttcgcaaccagataatcatagatggactgattgtaagtcagttcagcctccgtaagctgcacttgcgaagtgttcagctccaacactgtacctttgcctacctcatagcgtttaccggcaatctgcacagctttctgtgcctgcatcacattctcgcggttgctgacaacctgctctgaactggcagccatattgttctgatagctggtaatctgcatgttcagcttgcgctctgtgtccagacggttctgctccaactgacgtatctgaatacggttggacttgagcttggtgaaattgcttgccttatacaaaggaatactcagcgtaaacatcagtgcggaacttccgctccaattataatcgaggatgttccagtcctcgttgtagagtgactggtattggtaagaataattcatacccaaagtaggcatgaagttggtacggagtgacttgatgttctgattgagcatcttccggttcaagtccaactgcttcatcgtcgtattattgttcagattagcagcgggctgattcagttcattggcaaacagctccgtctcatagttgccgagattgtcggcaatctctatatccacatcggccgttactcccatcagtaccttcaactgcaacttggacaacgtcacggcattacccgccgaaatcacattcggcttaatgctgcgcatctgcacctcggcactgattttatcgaactcactgacggcaccctgctgatacttggcattgacaatgttgtagttgtcttctgccagcttatagctcttctgcaacacatcgtaggagtcttgcgtcagcatcagctgatagtaacccttagttacctggttcaccaagtccagcttagaagcccgtgacttttccacagccagttcaatgtctgtcttcgtcatcgacatggccttatatacgctaggggcgaatatgggcaaacagatattcagcaccccgcttaccgtattcgaattgtccatacccatcttgaacgactgtccgccaagattcatctgtgccgcactgatggtatgattccacgtaccgtcaatgcttgcctgcggaagcaagttctgccaggtttccttgtgagtcactttcttcaaagcaatttcttcctccgccacctttatggtaggattgtcgcttaaagcaatctccaaggcacggtcaagggtcagggtcagggtatcctttgtctcttgtgcgcgcacatagccgccggcatacagcacagcaactgccaacagtagtgctctgcctacccaaaatctctgcatcttcataaatcaaaaatagattatttattaaaactactccttcgtttcatccggctttacctgattcttgcgatattcgcagataaagtcctccaggacacgggcacccttctccgtagagataccgcgcaagaaagtgaacatgatagattcgtacacttcaaggaaagaatactcattgcagatgtccgaattcatcagcaaatcgagctggtcgcgcacaagcagattgataatagcaaaattcacatcatcacggaaaatgccttgcttcacgccctctttgaaaaagttcacggtatcttccgagctccggttccggttgttcttcatcaactgataagccttgggatatttcttgatatcctcaaaaaacttcttgttcgtggcatgaaaacgctctatgctccactgataacatctcaacaaaacttccaatacgttgttggaagtctctatgacttctttcacaaaaatatcaccatccttctgggacttcaggatacattcttccagcaaggtttccttatccggaaaaacttcgtaaagagtgcgcttagagatacccaaagatgctgcaatctcatccatcgtgatactttttattccatttgttgtaaataattctacagcggccagaatgatacgttcccttagttccacccgtgatgttgaatgcttcgtgtgttcgcccatttttcttccctttctaaactaaaactatttttattcattatcggaataaaacgagacaaatatagaaagaaaactcaattcgccaattaagtttcctttcttattgttaacagattaataattattatgtttctggcagatttattgggaagttcctaataatcaaactttgtccggttgaggaaagcgactgtcttatggatttccttatacatcacgatgtcctccttcacaaagggaacttccttgcggtattcgtgcaggaaacgctccaaaacgggagaagtctttgccggacggcggaagtcaatgccctgagcggcattcatcagttcgatggcaaggatatgctccagattatccataatgcgataaagcttagtagctgcattggcacccatgctgacgtggtcttcctgcccgttggaggaaacgatggagtcgctgctggcggcatagcagtacattttgttctggctcaccatagatgcggcggcatattgcggaatcatgaaaccggagttcagacctggattggcaacaaggaattccggaagtccgcgcaaccccatgataagctgggcgatgcgccgctcggatatattgcccagttctgccagggcgatgccgagaaagtcgtaggagatggcaagcggctggccgtggaagttaccgcccgaaatgatacggtcctcatcggggaagatagtgggattgtcagtcacggaattgatttccgtcagcagaacggaagacacgtaacggatggcgtctttcgttgccccatgcacctgagggatgcaacggaacgaataagggtcttgcacatgctgcttgggacgagctaccagctcgctgccttccaatagcttgcggaagttggcacccgtttctatctgtcccttgtgtggacgaatctgctggatacagtccatgaagggatcgatacgtccgtcgaaagcttccagggaaagggcggcaatcaagtcggctttcttggagagacgaaaggctttgagaatggcaaagacaccgttggcactcataaactgggtgccgttgagtaatgccaatccctctttactcatcagcttcaccggttcccagccgaactcgtcgagcacgctgatagcctcgcgcttctttcctttataataaacatcgcccacaccgataagcggcaggaagaggttggccagaggagccagatcgccggaggcgcccagtgaaccacggtcatacacaataggcatcacgtcgttattgaaaaagtcgaggatacgctgcacggtaataacctgcacaccgctatgccccaaagagagggcatgcgccttgagcaacatcatcagcttgatgatgacgggacgtatctcctcgcccacactgcaagcatggctcttgatgagattctcctgcaaggtgcccagctcgtccgacgaaatgctcttgctgcacaacgagccgaaaccggtggtaatgccatacaagggttcttccgactccgcaatcttcttgtccagataatcgcggcacttctgtatccgcagcttggcttccggagccagctccagtttcaagttttcattaatgatgcgttcgatgaggtcgaaggtcagctcaccggaacctacgtaatagacattgttcatactttcagctcttgattgatttcgtccaacaattccttttctttcgcacaagccaagtgttccaattcatcggcttcactttggagcttggacacaaactccttgtccttcaacgaacccaggttgatgcgtacattcatcagtgcgcccagcacagccgaacgggcagacatcatggctacacaagcatccgtaacggcattgcgattgcccatgcgggctatatccatgatgactgtcatcaactcatacgcattgcgtgccacctgcataggaacaagggcagcaaacttggtagcctcctgaatggcagcactgcgcgccgctttttcctcatccgtagctttcggcatcttgaagcaggcaaacaccttgttgtaggcctcagagtcgcggtctatatcttccacaaaagctcccttctgctgcaaggcaactccggagacatggcgcatcagctcttcgtgaagttcataacctttcttgccgatggtgaggttggcaaccatagcggcaagagcagaagcaatggcaccgttcaaagcggcaatactaccgccaccggggacgggatcactacccgccactttattcaaaaattcctttactgtcaaatcaactaacatggtaataaattattaaggattaaatattaatgttcaaggagctctaaagtcccggataaagaactccgttcttcacggtggtattgacacaattcatcccgacgtaatagggcaaaaaatgataattgtccgtatcgaggactacaaaatccccttttttgcccacctcgatactaccaatgctgtccgcacggttcaaggcggctgcaccgttcaaggtcagggcagtgatggcctcttcaacactcattttcatataaatgcacgccaaggcaaatgtcagggggatggaaccggagaaacaactgcccggattgaggtcggtggcaagagccacggcacaaccggcatcaatcatttcgcgtccacgggcatagggttccttcaaagcaaaggctgtcagcggaagaagggtcgccacaacttctttattggccatggcgcggatgtccgcatccgaagcatgcagcagatggtcggcagagacggcagaaagttcagcagccagtccagcaccacctaatggtacaatttcatcggcatggagtttcaaggcaagtcccatttccttggctgctagcaaaaggcgacgagactgttcgatggagaaaacaccctgctcacagaagacatcgcagaactctgccaaattattatgaaccactacgggcatcacttcgcggataatgtagtccacgtattcgtccgtccgcccgttgtattctgcaggcacagcatgtgcgccgagaaaagtggagacaacgtctacacgcttgtgctcgtcattattaaggctacgcatcacccgaagctgcaggagttcggtttccttgtccagaccgtagccgctctttccctctacggtagtcactcccatagcactcatctgcttcagaaagccctccgccttgctgcgcagctggatgaaattgcatgcacgggtagccttcaccgtactcacgatgcctcctccacgttccatgatggacatgtaactctctcccttcaaacgccaggagaactcctcggcacgctcgccaccaaacacaaaatgtgtgtgtgagtccacaaagccgggcagcagacacttgccgcgggcattgtaatgccagtagtgctgataatagccgtcacgctcctctccacggttgggaccgacgtaggtgatgacaccgtcggtcacttccaccgtagcattgtcgatgatgctcagttgctccatctcgctgccgcgacgggcggaaaaaccgaggggggtcacgacacgggcattgaatataataaggttctctgtcataaagcctctcccctaacccctcccccgtaaggaggggaattaagttagtactatttaattcggttacattcgtgcttctaaaacttgctccatggagaagttctccaatcccagatagtaggacgctgtatctatcaaggcctccatcggcaccagaccgataatctcactgcccacaatgctgacaccgtagcggcgggcttccacacgcaccagttcgaaagcacggtagagggcggtgcgggtatagtccgtcatgttgatggatacctgcgtgatgccgcgatctttcaactccactcccattgccttgcaataacgcagtccgccgccgatgaaacggattttcttagcgatgtcatgggctatctccagactgggagtattgaggttgatgttataggccaccaaaggcatgcgggcaccgatagctactgtgcctgcggtgggatgacgttcagccgatccaaagtcgggatgccattccggttgctttatcttctcggccataccttcgaactcccctttacggacagcggccagattctcccgatgaggggcagaagcagacttttcatataagaagacaggaagattgtaacgttttgcaacctcctcgcccacctctttggagagggcaacagcttcttccatcgtcacattccggatggggataaaaggtactacatctacagcacccatacgagggtgctgtccctgatggtgattgagatctatcagctctaccgctacgccgatagcttcgagcacagcatcacgaagcggttcaggctcacccactacggtcaccacgaggcggttatggtcttcatcgttgctgtaatccaacagtttcacaccttgtttgctccgaaaaggagccactatcttatctatcttttgcaaatcgcgcccttcactgaaattggggacgcattccataattctgtccataatattctaatatgctaatgtgagtaatatgctaatgagagaatatacacatgcttctaatcaaatcctcatccgccacatacggcatcgtgatatgatagccatctgcatgcgtacggttaaactcttcactcgtctccatggcatgagggttacgcgcccacgaacggcgtgccacaccacccatcacatcccacagcatggcggaacgcaagatttcgtctacccgctcactaccgtcgcacaccatgccgaaaccgccgttgatggcttttccgatacctacgccacctccattgtgcaaggccaccaagctcatgccacgcgcacagtttccggcaaaacactgtaccgccatatctgccatgacattactgccgtccttgatattggatgtttcacggaatggagagtctgtaccgctgacatcgtgatggtcgcgtcccaacatgatggggccgacctctcccttacgcaccatttcattgaagcgcaaagctatattcatgcgtcccacggcatcctgatagagaatacgagcctgcgtgccgactaccagattgttcttctccgcatcacgaatccaattgtagttatccaaatcttgcccgcgacgtgtagggtcgatacattccatcgccgcacggtcggtcttcaccaagtcttcatgttttccactgagacacacccagcggaacggaccataaccataatcaaacaattccggtcccataatgtcttccacatagctggggaaaatgaagccgttcttatcgtccccgtctcgcgcaatttcgctcacaccggcatcgtagacggctttcatgaaggagttcccataatcgaagaagtatgtaccgtgttccaccagcctctttatagccttgaaatgacgctccaaggaaacattcaccaggcaccggaactccgacggattttcatgtagcatacgggtacgctgctcaaacgtcagtccgacgggacagtaaccgccctcgtaggtggcatggcaggaagtctggtcagaaagtaaatctatgtgcaactgcttctgcaccgcatattccagcaaatcgacgacattgccgtgataggccacagaaaccgggcggcactcatccatcgctttttgagccagcgagaaggcttcttccagagaatccgtaacgtgtcccacccaaccctgggtatggcgggtttcgatgcgggaagcatccacctcggcaatgattgccgccgcccctgccatctcggcagctttgggctgcgcaccgctcatgcctcccagaccggaagaaacaaacaagcgtccgcgcaaatcaccatcctgcggaatgcccagcttcagacggcccgcattcagcagcgtattaaaggtgccgtgcacaatgccctgcggaccgatgtacatccagcctccggcagtcatctggccgtagttggcaacgcccatctgcatagcggtgtgccagtccttctgattatcatagagccccaccatcagcgcattggtaatgatgacacggggcgcttcgggcttggatttgaacagtcccaacggatgcccgctttcgataaccagtgtctgctcgcgcgtcaacacttcgaggtactgcttgatgagccggtattgcatccagttctgacagacctgtcccgtctcaccataggtaactaattcatacggataaagggcgatgtcgaaacaaagattattgtcaatcatcacctggaaggccttgccttcaatacagttccctttgtactcatcgatgggtttcgctttgaggtcgccctgcgggcggtagcggtagccatagatacgtccacgtgtacgcagttcttccatgaactccggagcgagggtttcgtgcagctctttggggatgtagcgcaaagcgttcttcaatgccgtagccgtctgcgcaggggtaagggtgtagccacggtcgggtgcccgccggataccctcgacaaaggaaggataggaaggcaatgttttacttaaggttatctccatgtcctataaagattaaggatttacaaagtgtcagcccacgagggctatatttgccgcaatatagaaataaatcccgacattcgcaatggaatgccgggattatttatcttttagtcagaaaccaacaaagaggatttctattttaaagccattttattgattttcattatctgatagacaccttcataatcggcggcaaatccgtcatcggctttgcccatatcgattacttccaactctacgtataccggttttccgtttttaactcctttcgtcatatcatcatatttttgcatgagttctccggtctcatccacaatccaataatcggcagaatctccttcggctttgaaggaacgcacctcatggccgatgaccagctcgcctcttaccgacagaagtttcttggcaggggtaagcaccgcagcaggtattgttttttgattcagagcttcattgttcctggcatatttcaagagcaactctcctcttttgagaatcaggctgtcctgcgtcagtttttctattgtcagcgtatccgtgaaagaaatattctggtgattgccgatgctggtacctgaaagtaacaaccggtttcctacttttttccatgcctcatatttcaaggtggccatgttaatggaagaggcgcttccgtccctatcaagaacgaaaccttgttgcatgccgggcattcccggaaccggctccacccaggagccttcaatggaggcattgttgcaagcagccaaagcaaccatgccaagaacagcagttaaatctctcaatcttttcatatctcttctctttttaaaactatatttctaaacaaaggagctcttgtttttcctctattctcttgcaaaaataatgtttttacgggaacttccacgcatcaaagaatcttttcacgaaacaaattatgaatatttatttggaaattattcaaactagcattacctttgcaccgaaattcaaaaacgatatgaaccagtacttaactacaagatacaatacgcgcaatgctgcatggggcaacaagaccttatgcggccacttcatagtgcacgtacattggttcagcggattcatttaactatcctgcaatttgcatcttactattttgcacttcccttaccgagaaaaggagggagagatgccgtgtatggagtttccgttcggaaaaaccggactaacctatgtattcacccaaaaaagaaaaaaacttatgtttacaattatatccatcatgtttataggaatcggtatcggatacctaatgcgtaatgtacagatgttgcaaaaagtggagaaaagcgcctcgctcaccatcttactgctgctctttgtactcggtgtatccatcggttccaaccgtctgattgttgacaatctgggaagattcgggtggcaggccgccgtactggcctcactgagcattacaggcagcatgctagcctcactgatggtgtttcacctattttttaagaaaggagagaagagatgaagggaagtttgatggttgttgcatttttctgtgccggctgcctgatgggagtagccaatgattttcagttcgacctgcacgacttatccatgtatgtgctctatgcattgatgttccaggtgggcatcggcatcgggagcaacaagcaattgaaggagctggtcaagagtctgcggcccaaaatgcttttggtgccgatggccaccattgtgggaacactgttgttctccgccttcgccagtctgctgttgagccaatggagtgtgttcgactgcatggcggtgggtagcggatttgcttattattcgctttcctccattctgattacgcaattcaaggaaccttccataggtctgcaactcgccacggaactgggcaccatcgccctgcttgccaatatcttccgtgaaatgatggctttgctgggtgcaccgctcatccggaaatatttcggcaaactggcacctatatcggcggcaggggtcaattcgatggatgtacttctaccctccatcacccaatattccggaaaggatgtgattcctatcgctatattccacggaatattaattgatatgagtgtaccggtattcgtatccttcttctgcaatctgtaaacagcgggccaaaaaaggaggataaggcctcattgtattcatactttaacaacgtgaacaacagagacttctcactgcaaagtgagtgcatgctttttgcagtgccactgcatacctatttgcagtgatactgcaactgctttgcagcgcgactgcaacgggtttgcagtgacgctgcaaaaggcgtgcaatgactttgcagccggtcaccaagctaccgcatactcgtagcggtcgaacttaggcttggtgcttatgcctactgccttgaatacccgggctatccgttgctgttcttcgggagagatagggcgctcgcccttgcggcaatgatagtaatagcgttcacaagagaagcatcccatcacgcgatggcgcacggtgaaaagcagcttggtgggtacttcgttgaaaaggtgcgtcataccgcgggcatagtgcagctgctcgctggagcggtaacgggcacaagtggaggacccggacaagctgccgacataaaaaggattcaccgcacgaacggactgtggctgggggccttcactctcggacaacagttgtgccgctatcgcccgcaagcaggaagaggctttggggcacttcccgttacccgcaaagcagtattcgtacccatcgggcacgtcttgcaataatatcatcttattaatgattaatggttagtgattaatggacggagtgcacgcagatacttgccgatgacctctgccgactcgcttgtttctttctcgaattcggcgtgcagtgtcgggtatccggcaagcagttgcatcattcgctcacgtcccacgaactcggactttccagtttcgggattcagttcgtaatagacgcgggcatgcaccagtcccgaagcattgatggcgtctcccacttcaccgcccaatcgtgtggcatcatcgggagtcatggtactggtggctgcttgtcccacaggctgtgcacagaagtaaacctttccgccgagccacatggcaggtgcataccactgcccgaagcgataacgcttatagcgcatcttacggcaattgacataaagcgaggtatctacccgtacagcataacaacgggacttcaaataacggcaaagaccgggattgtcgtctaccgtaatacgataatcggcaccgcccatgaggtaaatctggttctttgtacgcttctcaatcttcagcgtggtaaccgtatcgccacggttctccaccaactctttcagattggaatacattacctgttgcgccgccgccggcaaaaccgccagcaacatcagaacgcctgacaaccaactcttcttcatatcccaacctcctcttttctgaaactttgttttagtgagcgaaaggtacattttttatcggaagtagacaaaaaatcgcggaaaaaacaattgaaaatgtatatctttgccttaaacttaacatgtatgaagcaaataaatacgatagataaaatcagcgccgtctaccgcaacacggcagaagaggcaagacaagaactgaataaagtacaacagaagatttaccgcatcggcagcctgcgcctgctgctgtttgtggcaggagtagtaggaattatctatttctggagcgagagctggggtatactggcctgcattgccctcatcaccctactgccattcctatttttaatgaaataccacaaccggctgtttcgtcgcaaggactatctggaaaagaagatggaaatcaacgagcaggaactcgccgctctggattacgatacgtcttctttcgatgacggcgaagcatacatcgaccccacccatctctacacctatgatttggatgttttcggtccgcattcccttttccagtacatcaaccgtacctgcacacagcccgggaaacaccgcctcgcccactggctgggaaaacatctcgagagaaaggaagaaatcatccgccgccaggaagccgtcagcgaactggctccggaactgaaattccgtcagcgcttccgtatcctcggcctgctgtacaaaggaaaagccgccgatgaaacagaactgtgccaatgggcggaaagtccgagcatcttccggaaccgaaaactactgcgcctcctgccggtgctggtgacgggagccaacctcatctgcctcgcactcgtcatggcaggaattctacccgcaagtatctacggcatcatctggaccagcttcgtcatctccggcttcggcttcactggcaaagtcaccaagatgcaggccatctatggcaaaaaactgcaaatcctctccacctacgccgccctgctccacctcatggaaaagcagcctgcacaagtcaccctgctcaaagagataaaacaacagattggcggagaaaaacggaaagcctcccactccatcagcaagctgaacaagctcatggatgaactcgaccaacgcaacaatgtctttatgtacgtcattctgaacggcctcttcttctgggagctgcgtcaaatcatgcgcattgaagcctggaaagagcaatatgccgctgaactgcccgggtggctcgatgccatcggacaaatggatgcgctcaactcactggcaacatttgcctataatcatccggactatatttacccaaagatagttcaagcggaaagaaaggggaaaggaaacctgaataaagaagaagaaagcaattctgaaacggaagcacccatcaatgccccttcctccttccgtctccgtgctgaagccctgggccatccgctgatgaaccgtgaccgctgtgtccgcaatgacatcgacatggtgaaacgaccgtttttcatcatcgtcaccggcgccaacatggcagggaaaagcacctatctgcgtacggtgggcatcaattacctccttgcctgcatcggcgcccccgtctgtgcccgccaaatggaaatatgcccggcccggctcatcactagcttgcgtacctcggattcactgaacgataacgagtcctacttctttgccgaactcaaacgtctgaaactcatcatagacaagctgcaggcaggtgaggaactgttcatcatcctcgacgaaattctgaaaggtaccaactccatggacaagcagaaaggctcctttgcccttatcaagcaattcatgactttgcaggccaatggcatcattgccacccacgacctactgctgggaacactcatcgacctcttccccgatgacatccgcaactatcgcttcgaagcagacattacggacaatgaactgacattctcctaccgcttgcgcccaggcatcgcccagaatatgaacgcctgcttcctgatgaaaaaaatggggattgccgttgccgactaatccccaccacagttaaagtcaagtctaacgctttgactgattatgctgttttacatttctccaggaaagtagacactgcaaccgcatcgctacccgtatagtagcgtacggaagttaccggagtatacgtgtaaggcacaaactgatacaactgtacagccgcaaatttattgtcctgagaaatcatgacatccatgcgcacatttccactgccgctactttttatttcagtctcgccattcagctgttcattctcaatcatatctgtaagtttgcccaaatatttcaaatcgaagaaaacactgcgttccttggtcacactgcccgtcggcaaatagaccacttccttcgatttccaaaacagacggaacacgccaagcaagacgaatgccgtacccagcaccatcaaagccatgctgagagtggaagatttatcactcatctcaaaaatggatgcaaaaataaaaacaccgaccagcagcatagctactgaaaagataagtcctgaaacactggtacgctttacaatatcgggatgtgaagacgcaaaaagagttgcgtcaatagtttgagttgccataattataatatgttttaatgaatttattagaaatagaaaatacagtattcccctgcaaaaacacatagtctgaccatacacaagggaaaaaggaagattcaataaaacactaaatgagaatacgccttagtgtgaaaatgtaatattcgcacaccggctggcaacgataataggcagtggcatcatagagtttctcacgatgcagagacaaaacagccgctcgctgggccagtttgtcaatccagtcctttaaagaaaatatatattccgtggtagaaatacgctgtatacgggagtacgtcagcgaatgtaattgtccacccatgcccgccagctctgcatccggcagataaggtaattgaggcatcgcaatataggcatcagtctgctcatgtacggcaatagtattctcactcacaacattccccccacttgccgctttatttgcaaatgcatcgcttgcagtctgccataaagccaatgcaagcaccatgaatcctatgaatcttaagaatttagccatatctatgtgcaaatataacagtttctaccaggaatttgttttgtgcacacatcttttaatgtttcttggatgatttataggaaaaaaaagccgttccaaacaaattggaacggcttctatatataaaaagaatagttgaattattcagctttagcttcctcagcagcaggagcttcggcaaccggtgcagatgtttctgcagcaggagcagcttcagtagcagcggctttctttgaacggcgggtacgagtagccttcttggcaaccttttccttagccatattttcgttgtagtcaacgagttcaatgaagcacatttctgcgttgtcacccaaacggttaccagtcttgataatacgagtgtaaccacccggacgatcagcaatcttcacagagatttctttaaacagttcagttacagcatacttgtcttgcaaattgctaaatacaacacgacgggaattagtcgtatcgtctttagcctttgtaatcaaaggctcaacaaacttcttcagagctttagcctttgcaacggtcgtagtgattcttttgtgcttaatcaaagaacacgccatattagccaacatagcgtttctatgagaggcagtacgacccaaatggttgaatttcttattatgtctcattttttattctttatctaatttatatttagaaatatcagttccaaacgacagattcagactttccagcaaatcatcaagctcggtaagcgatttctttccgaagtttctgaatttcagcaaatccgtcttgttgaattgtaccaagtcaccaagagtctctacatctgcagccttcagacagttgagggcacgtacagagagatccatatcaacgagcttggtcttcagcaactgacgcatgtgcaatacttcttcatcaaactcttcattgccgtcagcatcatttgtttccagcgtaatcttctcgtcagagaaaagcatgaagtgataaatcagaatctttgctgcttctttcagggcttctttcggatgaatggaaccgtcggtagtaatctcaagtaccagtttctcgtagtcggtcttctgctctacacggaagttctctacctgatacttcacattacgtatcggagtataaatagaatcgataggaattacgttcacatcggtgcaatattcgcggttttcgtcagcaggaacataaccacgacctttgttgatcgtaatatctatctgcatagttgactttgaatctaaatgacaaataactaattcaggatttaacacttcaaatccagtcaaatacttacctatgtcacctgctttaaattcacttgaattctcgaccgtaatacttactttctcactctcgaattcttcaactacttgcttgaatctcacttgtttcagattcaagataatgttagtaacatcctcttttgcccccggaacactggaaaattcatgctcaacaccgtctatcttgatagtagtgatagcaaaaccttccaatgaagaaagcaggatgcggcgcagtgcattacccacggtaataccgaaaccgggctccaacggacgaaattcgaattttccgaatctagagtccgcttccaacattaatactttatcaggtttttgaaatgctaatatcgccatgaaattaattattatttagaatacaattctacgatcaaatgctctttaatgttttcaggaatgtctgctctttcaggtacatgcagcaatttgccaaccttagagttatcatcccattccaaccaaggatatttgctatggttaaaaccagccagtgagttagcgataacttccaatgatttggatctttcacgaacaccgatcacctgacccggttttactgcataagaaggaatattcacaacctcaccgtctacagtaatgtgcttgtggctcaccaactgacgagcagctgcgcgagtaggagcaatacccaaacggaatacgatattgtcaaggcgaccttccaacaattggagaaggatttcaccagtaatacctttagcagtctcagccttctcaaacaagttgcggaattgtttttccaaaacgccataagtatatttagccttctgtttctcacgaagttgaacaccgtattcagaagtctttctctttctggaattaccgtgctgtccgggaggatagtttttctttgacaatactttatctgctccaaagataccttcaccgaatttacgggctattcttgattttggtccagtatatctagccatttcttttaaatatttaattgtttattcatgaacttgggtttgttgcagccgcgattgcagagagaaagtttacaatccaataacaaaatcaagtctcacttctattaaaggtaaattttaaactctacgtcttttcggaggacgacaaccattgtgcggaagcggagttacgtcaatgatttcagtaacctcgatacctgcaccgtggatagttctaatagcagactcacgtccgttacccgggcccttcacatatgcttttacctttctcaagccaagatcgtatgctatcttagcacaatcttgagcagccatctgtgctgcgtagggagtgttcttctttgaacctctaaaacccatctttccggcagaagaccaagaaatgatctgaccttcgctgtttgccagagaaacaataatgttgttaaaagatgaatgaacatgcaactgtccattagcatcaaccttcacatttctcttttttgctgcaactgttttttttgccatatcaacaattattatttagtagcttttttcttattagcaacggttttctttctacccttacgagtacgggcattgttctttgtgctctgacctcttactggaagaccaatacgatgacgaacaccacgatagcaaccgatatccattaaacgcttaatgttcaattgaacttcagaacgaagatcaccttcaaccttatactctgcaccaatgatctcacgaatcttggcagcctgatcatccgtccagtcttttactttcaggtctctgtcaacacctgctttatccaaaatttttgctgaactactacgacctataccatatacataggtcaacgcaatttcacctctcttgttttgaggcaaatcgacaccaactattcttatagccatatactaaattattttttttgcaaaaataataatattatccttgacgttgtttatacttaggatttttcttgttaataacatacaaacggccattacgtctaacgatcttacactctggcgtacgtttctttaaggatgctcttactttcatatcttaattttatttatatctaaatacaattcttcctttcgataaatcgtaaggagacatttcgactcttactttatcccctggcaggattttgatgtaatgcatccgcatcttaccggaaatatgtgcagtaatctcatgtccgttttctaattcaacacgaaacattgcattagacaatgcttcaactataactccatcttgttctattgcagattgctttgccatattaatttcttaaattgctttatctcctaatacttcttcaatgaactcgaatgatgacaatatatcagcttcaccagcaccgactgctatcgtatgttcaaaatgagctgcacacttgcggtcttttgtcctcaccgtccagccatcacgctccatgagtatttgtcggttacctaaagttatcatcggttcaatggcaatgcacaagcctttcttcagcattgtcccataaccacgttttccgtaattggggacctgaggatcttcatgcatttccttgcctattccgtgacccacaaactcacgcaccacaccataagaattagattcgcagtgctgctgtatcgcatagccgatatcacccaaccgcttgccgtgaacggcattctgtatccctatgtacaatgcttctttagtaaccttcagtaatttgcggacctcttcgtcaacttcacctacacaaaacgtataagctgagtcgccacaaaagccattcatgtaagtaccacaatcaacagacacgatatcaccgtctttcaataccacattatctcccggaataccatgtaccacttggtcatttacagatgtgcaaatagaagctggaaacggatcgccatattgattaggaaaacctttaaaggttggaacagcaccattgtctctgatgaactcttccgctaccctatccagctcttttgttgtcactccgggccttataaccttagctatctcagccaacgtctttccaacaagcaaattactcctgcggagcagctctatttcatcttctgttttaagaaatatcattcttcaaaaaagattaatatgcagctacattaccactgcggcctttaatacgtccggatttcagcaaaccgtcatagtgtctcattaacaaatgactttctacctgctggagagtatcaagcaccacacccacaaggattaacaaagatgtaccgccaaagaattgagcaaactcagctttcacaccgaatatgccggcaaatgcaggcataatggcaaccaaggccaagaagaaagaaccaggcaaagtaatacgtgacataatcacgtcaatatactcggcagtttgctttcctggcttgatacccggaataaaaccattgtttctcttcatatcttcagccatctgagtcggattaatagtaattgcagtatagaaatacgtaaacaatataatcaacactgcaaaaatcaaattataccaaaagcttgtatgatcagtcaatgcacgtacgaaaccgcttgcatcatttacattcgagaacccaacaagagtgataggaataaacatgatagcctgagcaaaaatgataggcatcacgttagcagcattcaccttcaaaggaatatactgtctagcaccgccatattgcttgttacccacaatcttcttcgcatattgaacaggaatctttctagttccctgcaccaaaagaatagcgaatgcaataacaaccagcaacacaacaagctcaatcaggaacattaccagaccaccagtcttgtccgtcatacgggaaatcaattcctggaataaggactgcggcagacgggcgatgataccaatcatgataatcagcgaaataccattaccgatacccttatccgtaattctctcaccaagccacaaaataaacatacttccagccgctaaaataatggtagaagtaaacataaacagagtccaatctaatgaagcatttaaagaaggaccagcctgcatcttaagattgagcaaataagaaggagcctgaaccaaaagaataagaatcgtcagataacgagtatattgattcatttttcttctaccactctcaccttcgcgctgcaatttttggaaatacggaaccgcaatacccagcagctgaatcacaatggaggcagagatgtacggcatgatacccaatgcaaaaatagaagcattggaaaatgctcctccggaaaacatgtttaacaaggctaaaagaccttcgcttgtctgttgatgcaattgtgtcagcattgacggattgatccccggcaaaacgacatacgaaccaaaacggtagattgccacaaacaatatggtaatgaggatccgttgtctcagatcctcaattttccatatattctttaatgtttcaatagcttttctcattgaattagagttttactacttgtccaccagcagcttcgatggcagcaacagcagtcttagaaaatgcatgtgcctgtacatccaacttagcagtcaaagttccgttacctaatacttttaccaactggcttgcagaaatgaaaccagcagcaatgaagtcactgatacctacagtctgcaagttctttgcttcagccaatttctgaattgtatccaagttgatagccttatactctacacgattgatatttttaaagccaaacttaggaacacgacgttgaagaggcatctgaccaccttcaaaaccgattttcttagagtatccagatcttgatttagctcctttatgacctctagtagaagtacctcccaagccagaacccggaccacgtccaattctctttcttgttttagtagatccctctgcaggttttaaattacttaagttcatattgtaattcgttttatattcaacaaataattacttaacaatggtaaccaagtgtttaaccttatccaccattccaagaattgaaggagtacattcgtgttcaaccacacgattcaacttatgaagccccagtgcatcgagagttctcttctgatcagcaggagcaccaattctacttttaacttgtttaatctttatagtcgacatattcttcctccttatcctctaaatactttttccatactaactcctctgttctgggcaaccatacgagcatcgcgcatttcactcaatgccaagatagtagcctttaccaagttgtgcgggttggaagaaccttttgacttagccaaaacgtctgttacaccaacactttccaatacggcacgcattgcaccgccagcaacaacaccggtaccgtgagaagccggtttaataaatacttcagcgccaccgaactttgcagactgttcgtgaggaactgtacctttcagtacaggcactcttgtcaggtttttctttgcagattcaacacctttggcaatagcagcggttacttcaccagctttaccaaggccccaaccgatgatgccttcttcgtttcctactaccacaatagcagagaaactaaaagttctaccacctttggttactttggttacacgattaatagcaaccaatctgtctttcagctctatatcgtttgtaatcttaactctattattaagtcctgccataatgattaaaatttaagtccaccgttacgggcagcatcagccacctcttttactctcccatgatacaagtaaccattacggtcgaaaacaacagtagtaatacctgcttcctgagcttttttcgcaatcagttcacctactttagcagcttgttccttcttaggcattttttcagtcatacccaaagaagaagcggcagccaatgtcttaccggacaagtcgtcgataatctgaacatagatttgcttgttacttctaaatacactcatacgcgggcattcagtagtacctgaaattttgttgcgtactctatatttgatcttaattcgtctttctatttttgttgtcataataatatcaatttaaatgattatttagcaccagctgatttaccagactttctacgaatttcttcgccaacaaacttaatacccttacccttatacggttcaggcttacggaaagaacgtattttagagcaaacttgaccaagtaactgcttgtcgcaagattccaatataatcaaaggattcttgtttctttcagacttagtctcaactttaacttcaggaggcaactgtataaagatactgtgagtataacctaaagccagttcaatgatatttccctggttagaggcacggtaacctacaccgacaagttccaattctttcttatatccttctgatacaccaacaaccatgttgtgtaccaatgaacggtataatccatggaatgcatgcttttgcttaggattatccagcattgcattttcattctcagccaaaacaacatgaccgtcttcgatggtaacattgatagcaggatttacatattggctcatttcgcctttgggtcccttaacggtaaccacgtcatctttcagagtaactgttactccagcgggaatactaatgggtaattttcctattcttgacattgctaattcctcctattaatatacataacacaaaacttcaccaccaatctttagttcagcggcttctttgttggtcattacacccttggaagtagatattatagcaatacccaaaccattaataacacgcggcatgtctttataaccggtatattgacgcaaacccggagaagagattctctccagcttcttgatagcgttaaccttgtttaccggatcatacttcaaggcaactttaattgtaccttgaggaccatcttctacaaacttataattaagaatgtagcccttttcaaaaagaatcttagtgatttcttttttcaaatttgaagccggaacttccacaactctgtgcttcgcttgaatagcgttccgcaacctcgtcaaataatctgctattggatcagtcatataaaaaataaattaaattaatcaggcctaccctgacaatatttaaaaaacaaaattaccagcttgctttctttacaccgggaataagaccgttagaagccatctcacggaactggattctggagataccaaactgacggatatatcctttaggacgaccagtcagcttgcaacggttgtgcatacgaatcggattagaattcttaggcaggtcctgcaatttctgtgcagcttcaaaagcttcagcaggatcaccagttctaacgatttgcttcaacgcagctctcttctcggcatatctggctactaatttagcacgctttacttcacgtgccttcattgattcctttgccatattatcaatcttttttagcgtttttaaacggtaaaccgaattccttcaacaaggcatacccttcttcatctgtttgcgcagaggttacaaaggtaatattcattccgagaattctagtaatactatcgatattaatttcagggaaaatgatttgttcctgaataccaagggtatagttacccttaccatcgaacttactttcaatacccttgaagtcgcgaatacgaggcagagctacacgaaccaacttttcaaggaattcgtacattctctcacgacgcagagttaccataacaccaatcggcattttcttacgcaacttaaagtttgcaatatccttacgagaaatggttgccacggctttctgaccagtgatagcagtcatttcattaattgccacttcaataatcttcttgtcagcaacagccatacccaaaccttgattgataacaatcttcttaagtacgggtatctgcatagaagaagaatactggaactgtgatttcaatgcaggcgcaatacggtctgcatattctttcttaaggctagcagtattactcattacttaatctcctctcctgattttttagaataacgcactaaagtgccttcagcacttacttttctaccaacacgcgttgctttaccagtctttggatcaacgggattcaaatttgacaagtggacagaagcttcctgcttcacaatgccaccttgtgggtttttagcattcggttttgtgctcttagacaccatgttgataccttcaacgattgcgcggtttttatcaacaagaaccttcaatacacgaccagtcttacccttgtcttcaccggagtttacataaactgtatcgccttttttaatatgtaatttactcattactcaaatcttttacaatattaaagtacttcaggagcgagtgacacaactttcatgttagtagcacgaagttcacgagctaccggaccgaaaatacgactacctctaatttcacctgcattgttcaacaacacgcaagcattatcatcaaaacgtatgtaagagccatcagcacgacggatttctttcttagtacgtacgatcaaagctttagacactgcaccttttttaatatcacttgaagggataacgctcttaacagaaacgacaatcacgtcccctactgaagcatagcgacgacctgtaccacccaaaacacggatacagagagcctcttttgccccactattatcacatactgtaagtctggattctacttgtatcataattacttagctctttcaattatttctaccaatctccatctcttagtcttgctcaaaggacgagtttccatgatgtgtacagtatcgccgatattgcactcattcttttcatcatgagcatggtacttcttcgtcttgctaacgaacttaccatatatggggtgtttctccttaaacttagctgctactgtaatggtcttatccatcttgttgctcagcacaaccccagttctttcttttcttaaatttcttgcttccatcaagctcatcatttattgttaagttctctttggcgtaattcagtcttcatacgcgcaatagtcctgcgtaattgtttgatctgagcaggattatccaaaggagaaatagaatgatttaaaatcatttggttgtaattagctacttctgcttcaactctttctaccaagtcgttggtaggcatctctttaatttctgctattttcatactccttacgcattttgattttgaatatcataatcacgtctaaccacaaacttggttgtgataggaagcttctgtgcagctaagcgcaaagcctctttagcgatttcataagatactccttcggcttcgataataattctacccggtgtaactggggcaacgaatccctccggtgcacccttacctttacccatacgcacatcagctggctttctggtaataggcttgtcggggaaaatacgaatccaaatctgtccttgacgttgcatatatcttgtcactgcaatacgcgcagcttcaatctgacggcctgtaatccatttcgtttccaaggccttaataccaaaagatccgaaagccaactggtttcctctttgggcattacccttttgacggcctttttgttgtcttctgaattttgtttttttcggttgtaacataattcctaaaaatcaaattcgttagcgattatttttctttcttttgaagttctttccgccattgtttccgctattgcttccacgaccactttccttgctttgcgtaaagttcggagccaactccttcttaccataaacttcacctctacaaatccaaactttaataccgagaagaccaaccttagtcaatgcttctgcatgacaatagtcgatatctgctctgaaagtgtgcaacggagttcttccttccttatacatttcagaacgagccatttctgcaccattcaaacgtcctgaaatctgaatcttgataccttccgcacccatacgcattgtattggcaatggccatcttaatggcacgacggtaggcaattttgccttcaacctgacgggcaatgttgttagccacgataacagcgtccaactcaggtcttttaacttcgaagatattaatctgaatatccttatccgtaaccttcttcaactcctccttcaacttgtcaacttcttggccacctttaccgataatgatacccggacgtgcagtacaaacggtaatagtcacgagtttcagtgtacgttcaattacaattcttgacacactagcctttgccagacgagcgttcaaatatttacgaatcttgctatcttccagcagagagtcgccgtaattctttccaccataccaattggaatcccatcctctgataattcctaaacggttgcttattggattaactttttgtcccatttaccttaattttgatcttcgttattacttttagaaccaacgaacaacgttacgtggtttgaacgtttacgaattctgtaacctctaccctgcggagccggtctcattcttttgagtgtggcaccaccatcaacaaaaatcttggttacgaacagctcgccactttcagctttacgttcgtttttctgctcccagttagcaattgcagagcgcagcaacttttccactcttgcggcagcctcttttgaagagaacttcaaaacgccgagtgctctgttcacctccatcccacgaatcatgtcagccacgagacgcattttacggggggaagtaggaacattttgcaatttcgcaaaatacatggtcttaagggcttcttttcttttttcagccgatattttttttcttgctcccattatattattactttattatttcagataaatcctgttttattttttcttgttaccagcgtgtcctctgaaagtacgagttggagcaaattctcccaacttgtgtcctaccatattttcggtaacataaacaggaataaatttatttccgttgtgaactgcaacagtatggcctacgaaatcaggcgaaatcattgaagctctggcccaggtcttaactaccactttcttgcccgattcattcatggcaagcactttcttctcaagcttaacgttaatatacggacctttttttaatgaacgactcataatttactcaattaatcagattacttctttcttctctcaataatatacttagacgattgtttcttcggagctcttgtcttaagacccttagcatacaatcccttacgagatctcgggtgtcctcctgaagcacgtccttcaccaccacccatcgggtgatcaaccgggttcataacaacaccacggttacgcggacgacgtcctaaccagcgagaacgtccagctttacccgaactttccaatccatgatctgagttacctacactaccgatagtagccttacaagtactgaggatctgacgaacctcccctgaaggcaacttgataacgcagtacttaccttctctggaagtcaactgagcgaagttaccggccgagcgaaccaaggcagcgccttgtcccggacgtaattcgatgttgtgaattacagtaccgaccggaatattctgaagtggaagtgcgtttccgatttccggagcagcagcctcacctgacatcaaagtcataccaacttgcaatccgttgggagcaataatatatcttttttctccatctgcataaaacaacaaagcaatacgagccgaacgattcggatcatattcaattgttttaaccactgcaggcacaccgtctttatttctcttgaaatctacgatacgaataatcttcttactaccgccaccgatgtagcgcatagtcatcttaccttcattgttacgaccacctgaagatttcttaccaaatacaagagacttttctggtacccgtgcagtaatctcttcgtaagtaccaataattttatgtctttgccccggtgttgtgggcttaaatttacgtactgccatttttattaaatattgctataaaaatcaatagtatctccttctttcaacgtaacgatagctttcttgaacgcattcgtacgtccgttgatgataccggcacgagtatagcggctcttatttttgccggcatacttcatcgtattcacatcaactactgtaacgttgtaaagggcttcaacttccttcttaatttccagtttattagcttcaggacgcacgataaagccgaaacgattgttcgttttatcagtaattgcagtcatcttctctgtcactaacggtttaataataattcccattatttaagcctcctttttacattaagatattgtcgatagcagaaagtgcactttcagcaaacacaacaaccccagcgtccaatactctataagtattcaaccctgagatagtctgcacattagcaccctttacattacgagccgacaaatatacgtttttatttgcttctggtaaaatcacaagcagctttttgtcagaaactttaagattttttgtcattgcaacgaaatctttagtcttcggagcttcaaaagagaagtcttccaccactacaaccgcgttgttctgagccttgtatgacaaagctgacttacgagccagagcctttactttcttgtttaatttgaagtagtaatctctcggtttcggaccgaatacgcgtccaccaccaacaagtaccggtgagttcatgtcaccacgacgtgcaccaccgccacctttctggcgaccgattttacgagtagaaccactgatttcgcttctttcctttgacttgtgtgtaccctgacgctggttagccataaactgtttaacatccaagtagatagcgtggtcgttgggctcaattccgaagatagactcgtttaacgtaatctttctcccagtgtcttcacctttaatgttatatacgttaacttccattatttctcaattattacgattgaacctttgcaaccaggaacagaccccttaatcaaaagaagattatgctccgcgattacctttaatacctgcaggttttgaacagttactctgtcgccaccaagctgtccacccatgcgcattcccttgaatacttttgcggggtaagaacaagcaccaatagaacccggcttacgagcgcggttgtgctgaccgtgagtagtctggcctacaccaccgaaaccgtggcgctttaccacgccctgaaaccccttacccttagaggtacctacaacgtcaacaaaagttgtgtcattgaacagttctacagtaacagtgtcacccagattcaactctgtttcaaattctttgaactcagccaagtgtttcttgggagttactccagcttttttaaagtgccccatcaaaggctttgtagtgtgcttctccttcttatcttggaagcccagctgaacagcttcataaccgtccttttctacagttttcacttgagtaacaacacaaggacctgcttcgataacagtgcatggtacattcttaccctcggcactgaaaacggatgtcattccgattttttttcctaataatcctggcatttcacttaatttttaatacttacactttaatttctacttccacaccactcggcaactccaacttcatcagagcgtctactgtcttagctgttgagctatagatgtcaatcagtctcttgtaagaagagagttcgaattgttcacgcgacttcttgttaacgaaagtcgaacggttcacggtaaagatacgcttgtgcgtaggaagaggaatcggaccgctaacgatagcgcccgttgtcttcaccgttcttacaattttctcagctgacttgtcaaccaagttgtggtcgtaagatttcagtttgattctaattttttgactcattactgtttttagttattaaatagttatataagatgaagttccgcaggctaagagtcattcgctagcctacgggacttcaagttttttttagattaagtcagcacggcctttcacttcctccaatactgccttggcaatagagttggaaacctgggcatggtgagaatataccattgaagaggttgcacgaccagaagtgatggtacgcaatgctgttacgtaaccaaacatttctgccagcggaaccattgccttcacgatacgtgcaccggaacggctagattccataccttccacctggccacgacgcttgttcaagtcaccgataacatcacccatgttttcttccggagtaacaacttccagcttcatgataggctccatcaataccggacccgccttagcacaagcgttcttatatgcctggatagcacagatttcgaaagacaactgatcagagtcaaccgggtggaaagaaccgtcaatcaaagttactttcagtgaatccagcggataaccagccaacacaccgttcttcatagcagtagtgaagcccttctgtacagacggaataaattccttagggatgttaccacccttcacttcgtcaacgaattgcaatccaccttccttgaagtcttcatcaaccgggccgatattcacgataatatcagcgaatttaccacgaccaccagactgcttcttgtaaacttcacgcaaattaactgtcttagtgatagcctccttgtagttaacctgaggcttaccttggttacattcaaccttgaactcacgtttcagacggtcgataataatatccaagtggagctcacccataccagagataactgtctgaccagtctgttcgtcagtcttaactgtgaacgtcgggtcttcttcagccaacttagccaaaccatttgacagcttatccatatctttctgagtcttaggctcaacagcgataccaattaccggttccgggaagtccatagattccaatacaatcggtgcagtttcgtcacacaatgtatcaccagtatgtatatccttgaaacctacgccagcaccaatatcaccagcaccgataacttctaccggattctgcttgtttgagtgcatctggaacaaacgggatacgcgttctttcttaccagaacgagagttatagatataagaaccagcctctatcttaccggaataaacgcggaagaaagtcaaacgacctacatacgggtcagttgcaatcttaaatgccaaagcagaagtcttttcgtcttcgctcggtttacgatcttcttcagcaccagtttcgggatttgtaccgacaacattctctgtatccagcggagaaggcaagaatgcacaaacgtaatcaagcaatgtctgtacacctttgttcttgaatgaagaaccgcaaagcatcggaacgacagccatttgcactgttgcgttacggagagctctcaaaacctcttcttctgtaatggtagaaggatcatcgaaatatttctccatcaaagcatcatcaaactcagccactttttcgagcatcttatctctccattcgttagcttcgtctaccagatttgcagggatttcctctactgtatagtcagcgcccattgtttcatcatgccaatagatagctttcattttgataaggtctaccaggcctttgaaagattcctcagcaccgataggaacgacgataggacacggattagctcccaaaacatccttcatttggcgaactacttcaaagaagtcagcgcccgaacggtccatcttattaacgtaagcgatacgcggtacgttatatttgtcagcttggcgccaaactgtctcagattgcggttcaacaccacctactgcacagtaagcagcaacggcgccatcaagaatacgcaaagaacgctctacctcagcggtaaagtcaacgtgtcccggagtgtcaatcaagttaattttataagtatcaccggcatatttccaacgagtggtagtagcagcagaagtgatagtgataccacgttcctgttcttgctccatccagtccattgtagcggcaccatcgtgcacctcaccgattttgtgggttaaacccgtgtaaaacaaaatacgttcagaggtcgttgtctttccggcatcgatgtgggccatgataccgatattacgtgtcaaatgtaaatcatgctttgccattttctaattcccttactttaagtttttaatcttctaattggttagtctcttatagtattagaatctgaaatgagcaaacgcacggttagcttctgccattctgtgcatgtcttctttacgtttgtaagcaccaccctgttcgttgaaagcatccatgatttcagcggctaacttgtcagccattgacttgccaccacgcttacgtgcaaagataatcaagttcttcattgaaattgactccttacggtcagcacggatttctgtaggaacctggaaagtagcaccacccacacggcgagacttcacttccacctgaggagtcacattatccagagcttttttccaaatttcaagagcggatttctcttcgttctgcattttattcttcactgtttccaacgcagcatagaagatttcataagaagtgttcttctttccatcgtacatcaaatgattcacgaacttggaaacttttacatcattgaacacgggatccggaaggataacgcgttttttcggttttgcttttctcatttgtctgaaagaataatgtttttcgttcttggttgtttacttctgtcttcttcaactctccctccggagaatttactcaacctttagcatttccaacaaactaaaacgtaagttattacttttaatttttctgtttttgggtatcaggccaccagattatttcttcttagcaggagctgcttgacccggtttcggacgttttgcgccgtatttggaacgtctttgtgtacgacctgcaacacctgcagtatccaaagtaccacgtacgatatgataacgcacacccggaaggtcttttacacgaccaccacgtaccaatacaatagagtgttcttgcaaattgtgaccttctcccggaatataagagttcacctctttaccattggtcaaacgtacacgagctactttacgcatagctgaattcggttttttcggagtggttgtatacactctcacgcaaacgccacgtctttgaggacaagagtccaaggctggagactttgatttctccaccagcacttcgcgtccttttcttactaattgctgaattgtaggcattttaattgtttttagttatatattattgtttatattaattcagaactatacacttttgggctgcaaagatactaataagttttgaataatcaatgcactacaagtttttttttaattttacgcttcacccttgatgttgggaagaggcggaaatgtttgttcgtccggcatgtgaatcggtccgaaagagcgttcgtatttcccaatattctcttcgagtgcacgcagcaaacgcttggcatgttcgggtgccaaaactatgcgcgattgcacaccagcctttggcattccaggcatcacgcgaataaagtcgagaataaattccgaactggaatgagttataatagccaaattggcatatgtaccttgcgccacttcttccttcaattctatctgaagttgaccgttgttgttttcttgattttccatgttgcacaattatttttaaaatgttcttaaaagatagaccaaaagtactcttttttttcggacgatatacatttaagtccccaaaagacacataataatccgtccagaaaaagaagcaagccactacaatcgttttgcagtagcactataacaaacatgcagaagcgttgcaatacagaaggaagaggcaaagataaaacagaaagggaatactccttcttataggatattccctctctctatttaatagaattatattgacgttgtaaggttatccctctactttctcgtctacagcataatcaagtaccgtcttcttgttagcaagcatacggtcgtactcttctttggagccaacaataatcttctcgaactcgcgctgtccggtaccggcaggaatcaggtgaccgcagattacgttctccttcataccttccagacggtccacctttccgttgatggcagcctcgttcagcaccttcgtcgtttcttggaaggaagcagccgacatgaagcttgaagtctgcaatgcagcacgggtgataccttgaagaatctgagtagaagtcgcaggtacagcgtcgcgcacttccacgggtttcaagtcgcggcgtttcaacatggagttctcgtcacgcagcttgcgggccgtcacgatctgaccagcctgcaaactctgggaatctccagcatccactaccaccttctttccccagatacggtcgttctcttccatgaattccatcttgtcaacaacttgctgctccaggaagcgggtatcacccggctcgtcaatttccaccttgcgcatcatctgacgtacaatgatttcaaagtgcttatcgttaatcttcacaccctgcagacggtaaacgtcctgaacctcgttcacgatatattcctgcacggctgtaggacctttgatggccaggatgtccgcaggtgtgatagcaccgtctgataacggagtaccggcacgtacatagtcgttctcctgaaccaaaatctgcttggacaacggtacgaggtacttcttcacttcgccggtcttggaagtaacgatgatttcgcggttaccgcgtttcactttacccatggtaacctcaccgtcgatttctgaaaccacagcaggattagacgggttacgtgcctcaaacagctcagtgacacggggaagaccacccgtgatatcacccgctttacctacggcacgcggaatcttcacgataacttcaccggcctttaccttttgaccgtcctcaaccaccacgtggccacctaccggcaagttgtatgtacggatcagttcgccgtcttctgtcatgatgtgtgcggtaggcaccttcgtcttatccttagactcaatgatgatgatttcgcgcaaaccggtagattcatcagactctaccttataagtcacgttttcaataacgccttcaaattcaatcttaccggtagcttcggtaatgataactgcgttgaacggatcccaacgggcaatcatcttgcccttctctaccatttcaccgtcagcagcatagagcgtagaaccgtaaggtacgttgtgggtagaaagaacaatacccgtgttgacatccacgaaacgcacttcagccagacggcctaccactacctttgcaggttcgcctgcttcgtcaataacgtctaccgtacggagttcttcgaattccaaacgggcagggttcttagccacgatacttgcgttggcagcgatattggctgccgtaccaccggcatggaatgtacgcagtgtcaactgtgtacccggctcaccgatagactgtgcagcaattacgccgactgcctcacctttctgaaccatgcggctggaagccagattacgtccgtaacacttggcacaaacacccttcttggattcgcaggtcaatacggaacggatttcaacactctcaatcggggaatcttcaatcttctgcgcaatgtcttcggtaatttcctcaccgccagccacaatcagttcgccagttgtaggatgaacaatatcatgtacggatacacgaccgaggatgcgttcatacagagtggcgatggtttcgtcattgtttttcaatgctgtacaaaccaatccgcggagcgtgccgcagtcttcttcattaataatcacatcgtgcgatacgtcaaccagacgacgggtcaggtatccggcgtcagccgtcttcaaagcggtatcggcaagacccttacgggcaccgtgagtagagataaagtattccaacacggacagaccttccttaaagttagaaagaatcggattttcaataatctgaccgccttcggcacctgctttctggggctttgccatcaaaccacgcataccggagagctgacggatctgttccttagaaccacgggcaccggaatccagcatcatgtatacagagttgaaaccctggtcgtcgcttgaaatggttttcatcaagatgttggacaactctgagttcacgtgtgtccagatatcgattacctgattgtaacgctcgttgttggtgatgaaacccatgttatagttattgattacctgctctacttcatcataacctttctgtactaatgcttccttctcttccgggatgatgatatcccccaagttgaacgacagaccacccttgaaggccatgtagtaaccgaggttcttgatcccgtcgaggaagtcggctgccttggcaacaccacacaccttgattacgtgactgatgatatcgcggagtgacttcttggagataatcgtattgatatatcctgcttctgccggaacaatttcgttgacaatgacacggcccacggaggtatcgtgcatcatcttgtccacaatgttgccattctcatcaacgtctttcactatgacgcttaccggagcgtgaatgtcgcacttaccttcattataggcaatcagtgcttcttctggaccgtagaatgtcaacccctcacctttggcacctttgcgcaacttagtgatgtagtacaaaccgagtaccatatcttgggcgggcacagtgataggagcaccgttagcagggttcaatatattgtgtgactggagcatcagcatttgtgcttccagaatcgcttcgttgctcagcggcaagtgaacggccatctggtcaccgtcgaagtcggcattaaacgccgtacatgccaacgggtgcagctggattgccttaccttcgatcatcttgggctggaatgcctgaataccgagacggtgaagtgtcggagcacggttcaacagcaccggatgacccttcatcacgtgttccagaatatcccagataacaggttccttgcgatctacaatcttcttggcactctttactgtcttcacgataccgcgctcaatgagcttacggatgatgaacggcttataaagctcagctgccatcagttttggaataccgcattcacccattttcaactctggacctacaacgattacagaacgtgcggaatagtcgacacgcttacccaacaaattctgacggaaacgtccttgcttgcccttcaaactgtcagaaagtgacttcaacggacggttagcgtcagtcttcacagcactcgatttacgagagttgtcgaacagagagtcgacagcttcctgcaacatacgtttttcattacgtaaaatcacctcaggagccttgatttcaatcaatctcttcagacgattgttacggatgatgacacgacggtaaagatcgttcaagtcagaagttgcgaaacgccctccatccaacggaaccaacggacgaagttcgggtggaataaccggcacaatgcgtacaatcatccactcaggcttgttgcgtccacgtgatgcacggaacgactcaactacctgaagacgtttcagggcttcggtcttgcgttgttgtgaagcatcgcttccggcacgattacgcagttcgtaagacaaagagtcaagatcgaggtgtgacagcaaatcgtagatagcttccgcgcccatcttggcaatgaacttattggggtctgaatcttcgaggaattggttgtctttcggcaacttttccagtaagtccaggtattctccttcttccagcaagtcgtactgtgccacttcgtcggacagtacacctggctgaatgacaacataacgctcgtaatagataatggcatccagtttcttggtgggcaggcccaacaagtaaccgattttgttgggaagtgaacggaaataccaaatgtgagccacgggcacaacgagctggatatgtcccatacgctcacggcgcactttcttttcagtcacttccacaccacaacggtcgcagacgatgcctttgtaacggatacgcttgtacttaccgcaatggcactcgtaatccttgataggaccaaagatgcgctcgcagaacaatccgtcgcgttcgggcttatacgtacgatagttgatggtttcaggctttaaaacttcaccactcgaattctcaaggatttcctcaggagaagccaaaccgatagagattttcgagaaattactctttatcttgttatcttttctaaaagccataaatttatttaattgataattgacaatggaaaattgaaattgaaaaactgaaaaccgataattgagaatggtaacttgcattatccattctcaattatcaattatccattattctaagttgatgctcaagcccaaacctctcaactcgtgcagcaatacgttcagtgactcggggatacccggagcaggcatcggctcacccttcacgattgcttcataagccttggaacgtcctacaacgtcatcagacttgatagtcaggatttcctgcagaatgtgtgcggcaccgaatgcttcgagagcccaaacttccatttctccaaaacgctgaccaccgaactgtgccttaccacccaacggctgttgcgtaatgagtgagtacggaccgatggaacgtgcgtgcatcttgtcttcaaccatgtgaccgagcttcagcatgtaggtcacacctaccgtagcctgctgctcgaatgcttcaccggtaccaccatcatacagcgttgtcttgccgtaacggggcaagccggccttatcggtccattcgttcaaatcgtccaaagatgcaccgtcaaagataggagtggcaaacttcacgcccaagttctttccggcacgaccgagaacggcctcgaatatctgaccgatgttcatacgtgaaggcacacccaacggattcagcacgatgtctaccggagtaccgtcagcaaggaacggcatgtcttcctggcgtaccacgcgggaaacaatgcccttgttaccatgacgaccagccatcttgtcaccgacaccaatcttacgtttcttggcaatgtataccttggccatctgaatgatacctgcgggcaactcgtcaccgatagtaatggcaaacttcttgcgcttcaactcggcatcgagttccttatacttcttgatgaagttcatcaccaacgcacgaatcagtccgttggtatgttcatccttcgtccagttgctcaactgaacagcagtgaagtccaaatcactgaagtcggaagcagagaatctggcgcctttggaaattatgtcggcacccatgtaatccttcacaccttccgatgtatagttttctgtaagcttcaacagtttgtttatcaatactttcttgagatcacctatcttggcatcgaattcgtcgtcaatcttcggcagcagagccttgtcggccagcttggagctgcgagtcttaataacacgagagaacagacgcttaccgataacaacacctttcaaagaaggagaagctttcaaagaagcgtccttcacatcaccggccttatcaccgaagatggcacggagcagtttctcttccggagaaggatctgattcacccttcggagtaatcttaccgataaggatatcccccggctcgatgcgggcacccacacgaacaataccgttttcgtcaaggtctttagtcgcttcctcacttacattgggaatgtcagaagtcaactcttccataccacgcttcgtttcacgaacttccaaagaatattcttccacgtgtacagaagtcaaaaggtcctcacgaaccacgcgttcgttcagtacaatagcatcctcatagttatagcccttccacggcatgtaagcaaccagcaggttcttacccaatgcaagctctccgtcttcggttgaataaccttctgtcaaaatttgacctgcagtaacgcgctggcccttctcgcaaatcggacggaggtcaatcgtcatgttctggttggtacggcgccatttcgggatattatattctttcaatgcaggctcgaagcttacgaattcctcctcttccgtacggtcgtacagaatacggatagtcgttgcatccacgaattcaaccacaccgtcaccctcggcagtaatctgcgtacgggaatcgcgtgccagctgacgttcgataccagtacctacaatcggagcttcgctcttcaacaaaggaacagcttgacgcatcatgtttgatcccatcaatgcacggttggcgtcatcatgctccaggaacggaatcaaagaagctgcaatagaagcaatctgctggggagatacgtccatcaattccacctcggaaggaggaaccaccggatagtcggcatcctgacgggattttactttatcacgtacaaaagtaccgtcatcgttcaaaggagcattaccctgcgcaataatcttggcttcctcttcttctgcggtgaggtaaaccaaaccttcgtcagaaaggtcaaccttaccatctgccaccttacggtacggagtttcaatgaagccgagctcgttgattttcgcaaatacgcagagtgaagaaatcaaaccgatgttcggaccttcaggagtctcgataggacaaagacgcccgtagtgagtatagtgtacgtcacgaacctcgaagcctgcacgttcgcgtgacaaaccgccaggacccagggcagacatacggcgcttgtgagtaatctcggccagcgggttggtctggtccatgaactgtgacaaagcattcgttccaaagaatgaattgataacggaagagattgtcttggcgttaatcaggtcaataggagtaaagacttcattgtcacggacgttcatacgttcgcggatagtacgcgacatacgtgccagaccgatggcaaactgattggacaactgttcgcccactgtacgcacacgacggttgctcaagtggtcgatatcatccacatccgctttcgagttaatcaactcgatgagatatttgataatttcgataatatcttccttggtaaggacacgcacgtccatatcggtcgtcaagttcaactttctgttgatacgataacggcctacatcacccaggtcatatctcttttctgagaagaacaagttattgataacttcgcgtgcactggcatcatcggctgggtctgcattacgcagctggcggtagatgtagagtacagcttctttttccgagttactcggatccttctgcagagtattatatataatagaatagtcagactggttcggttcttccttgtgtacgaggatattctgaacacccgactctaatataatatcaacatgttccggctcgattacagtttcacgatcgataacgacttcgttacgctcgatggaaacaacttcaccggtatcttcgtctacaaaatcctcaatccatgttttcaacacacgtgcggccaacttacgtcccaccatcttcttgagattcgtcttgtttaccttcacgtcttccgccaaattaaagatctcgagaatgtccttgtcattctcaaaaccgatggctctcagcaaagtagtaaccggcaatttcttcttacggtcaatgtaagcatacatgacgttgttgatgtcggtggcaaactcaatccacgaacccttgaacgggatgatacgggctgagtacaacttggtaccgttggcatgtacgctctgtccgaaaaatacgcccggtgaacggtgaagttgggatacaaccacacgttccgcaccgttgatgacgaatgtcgccttatccgtcatgtaaggaatgggacctaggaacacgtcctgaatgaccgtgtcaaaatcttcgtggtcggggtcggtacaatataatttcaattttgccttcaaaggcacgctatatgtaagccctcgctctatacattcatcaatggtatagcgcggcggatcaatatagtagtccaaaaactcaagaacaaaattatttcttgtatcggcaatggggaagttttcagcaaatactttatacagtccctcgttcttacgcttctcgggtggggtgtccagttgtagaaagtctttgaatgacttcaattgtacttccagaaaatccggatattcaagcggattcttagtcgaagcaaaattaactctttgatttacagtatttgaagacatctgttaatggatttgtagaacttaattttaaatatatacacaaaaaggttaagaacccttttcacgaagggttcctaaccgaattacctgatttacaggctaatgttatttaagttcaacttcagctccagcttcttccaatgttttcttcaatgattctgcttcgtctttagccaaaccttcttttactacgctaggagcaccgtctaccatgtccttagcttccttcaagccaagaccgcaagcttccttaacggctttaactacctgaagtttagctgagccagcgctcttcaatactacgtcgaaagaagtcttttcttctgcggcagcagcaccaccagctgcaggaccagcagcaacagctacagctgcagcagcaggttcaataccatattcttctttcaggattgttgcaagttcattaacttcttttactgtcaagttaactaattgttctgcaaaagctttcaaatctgccatttttgtatgatttttaattgtttaaatactaaataaattgatataattctttttccgaaatttacgcttcgggacgttcaccaagagtcttgagaactccgtggagggtgttaccacctgattgcagagcagaaataacattcttggccggtgactgcagcaatgcaacgatatcggcaataacttcattcttactcttgatacttacgagagcatccaactggtcagcaccaacatagaagctttcttctgcatatgcagccttcagtccgggaataccattcttagccttatctttgatcaacttggccggtgcgttagcaacgtcgctgaacattacggcagttgtacctttcagagaaccataaagcggagaaaagtcttcttccaggctttccaatgccttgtgaagcaatgtattcttaactaccatcaatttgatgtcagctttgaaacattctcttctcaacatgctggttgtagcagcattcatggcagtggtatccaccaaatagaagtgaccgtattccttcactgtagcagcaatctgctcaataatcgtacttttatcttcctttctcattattactccgttttattagatttcttctactgttttcgggtcaatcttgatgcccgcactcatcgtgctagaaagataaatactcttaatatatgtacccttggctgcagtcggtttcaatttattcaaagtagagatgaattctttcgcattgtcgcgaatttgctcagcgctaaatgaaactttaccgatagaagtatgaacaataccgctcttgtcaaccttgaagtcgattttaccttgttttacttctcttacagctttagcaacatccatagttacagtgccactcttggggttaggcatcaatccacgaggaccgagcacacgaccgagtgcaccaatcttacccatgatggacggcatagtgataatcacatcaatatcagtccatccacctttgatcttttcaatatattcgtcaagaccaacatagtcagctccggcttcttttgcagcagcttcagcatctggtgtacaaagcaccaaaacgcgtacaaccttaccagtaccgtgaggaagtgatacaacacctctcaccatctggttggccttacgcgggtcaacgcccaaacgtacgtcgatatccagagaagcgtcaaacttggtataagtgatttcttttaccaactgagcagcttccttgagagagtatgctttccctgcttcaattttttctgcagccaacttttgattttttgtcagtttacccattctaattgaagtttattaattattaaccgggaactccccttttacagcgatacccatacttctagctgtaccggcaaccattttcatggcagcttctacagtgaaacagttcaagtcaaccattttgtcctgagcaatcgtacgaacttgttcccaagtaatctcggcaaccttcttacggttaggctcagcagaaccactcttttgcttcgtcacttccaacaactggatagccacgggaggagtcttgattacaaaatcgaaagacttgtctgcgtagtaagtgataatcacaggaagaatctttcctgctttgtcttgggttctggcgttgaattgcttgcaaaactccatgatattgatacccttggaacccaaagcaggtcctactgggggagatggatttgccgcgcctcctttaatctgtaatttgattagtccagcaacttctttagccattttctaattgatttatatataaacattaatgaagaatactacagcgtaacacctgcactattctttttcaacttgcataaagcccaattcgagcggagtcttccgtccgaatatcttgaccatgaccttcagtttcttcttctcggtgttcacttcttcaatgattccactgaatccactgaacggaccgtaattcacctttacagtctcgccgactacatacgggatactcaagtcttcacctgattcctgcaattcgtcaaccgtaccaagtatacgattcacttccgactgtctcagaggtacgggtttttccgaaccacccaagaaccctatcacattaggagtatttctcagatgatgagcaacctcacccaccagagcagcctccaccaaaacgtaaccagggagataacttctctctttcacaattttcttaccattgcgaacctgatataccttttcggtaggaatcaatacctgagatacgtaatcaccaaggtcgctgtttttaatatcagcttcaaggtattcctttaccttagcttcttttccgctaatagcacgcaaaacgtaccatttcttttcaatctcagacatttcttcttacttttaatgtggataaacaaattccatcagatgctggaaacagaagtccatcgcaaatactaccactgcaattagtagggaagcatataaaacaactactgcactgttagtaagttcagaatacgtaggccacgacactttatgaacaagttcgtcgtaagtttctttaaaataagctacaatcttcttcatttcaaaaatattagcacgggaggagaggctcgaactcccgacacccggttttggagaccggtgctctaccaactgagctactcccgtttgtacataatcagttcccgatgtataccgggaactgattaagattatattggttattagtcaagaatttcagtaatctgaccagaacctaccgtacgaccaccttcacggatagcgaaacgcaaacctacgttcaatgctaccgggtagatcagttctacagtgatttctacgttatcaccaggcattaccatttcagttccttccggaagagtgatttcacctgtacagtccatagtacgcagatagaactgaggacggtatttattgtggaacggagtgtgacgaccaccttcttctttcttcaaaacgtagatagaagctttgaacttagagtgaggtttaatctgaccgggcttacaaagaaccataccacgtttgatttcgttcttgtcgataccgcggagcaacagacctacgttgtcaccagcttcaccctgatccagcaacttgcggaacatttcaacaccagttacaactgacttcttgtcttcacccaaaccaaggatttcaacttcgtcacctacatggataacaccagcttcgatacgaccagtagctacagtaccacgaccagtgattgagaatacgtcttcaaccggcatcaagaacggtttatcaacatcacgcggaggcagaggaatccaagtatcacaagcttccatcagctccataaccttctcttcccacttttcaacgccattcaacgcaccaagagcagagccctggataaacggagtgttgtcgccatcgaattcgtaagctgaaagcagttcacgcatttccatttcaacgagctccaacatttcagcgtcgtctaccatatcacacttgttcatgaatacaaccagtctcggtacgtttacctgacgagccaacaagatgtgctcacgagtctgaggcatcggaccatcagtagcagcaactacgatgatagcaccgtccatctgagcagcaccagttaccatgttctttacgtagtcagcgtgacccgggcagtctacgtgagcgtagtgacggttagctgtttcatactctacgtgagaagtattgatagtgatacctctttctttttcttcaggagcgttatcgatagaatcgaaagaacgcagttcagaaagacctttctttgccaacactgtagtgatagcagctgtcaacgtggttttaccgtggtcaacgtgaccaattgtaccaatgtttacgtgcggtttggtacgttcgaatttctctttagccatagctttacttgttatttatttgattaataatcagcttttacatttttgtgagctgttaccgggacttgaacccgggacctcttccttaccaaggaagtgctctaccgctgagctataacagcaaggagaataagagttgtgggcaaagatggattcgaaccaccgaaggcgtaagccagcagatttacagtctgccccatttggccactctggtatttgcccctacattataaaaagaactcttttccttactaaatcatcgcagagtaaactttacccgaacgatttccgttttcatatcacctccacctcgtgaagaaagacttattccactcatccttgagcgagcctcttgtcggattcgaaccaacgaccccgagattacaaatcacgtgctctggccaactgagctaaagaggcaagctaaaaaatgcaaccgtaacgttcatagcgtgagcgaaacggctgcaaatttagacatttattttttacccgcaaaattttagcggaaaattatttgctccgttgcttttccttgtacttaaccagctgtttttccaaagcttccagacataaatctaccgcttcttcaaacgtatcacaaaccttgtttgcataaaactcgccattgggaaccaacactttcactccggcttctttattttcggctgtttctggttttactacctttaatgacacctctactttctttatatcgtcgtaaaatttctccaacttagcaactttcttttgaacgaaagactgcaattgctctgacgcatcaaagtgaatcgattgaattcttacttccatacttacctcctttttactttaggctcggggatgagcctgattatacacttttttaagctcttcaaaagtagtatgcgtataaatttccgttgtcgccagactctcgtgcccgaggagttcttttatcgaacctaaatcagcaccattgttcagcatagccgttgcaaaggtgtgcctcagcacgtggggacttcttttttttacagtcactaccttcgaaaggtttcgtttcacaaggcatgctacgataccgcggtaaagcctctttccattcttccggataaaaaaagcatccgagcgaaccggaacagcctcattccgcacattgacatattccctcatcgagcgccccagctcctcatcaaaaggtataagacgctgcttattccgctttcctgtcactttaacgagagaagccgaaaaatcaatatctttgtcatccaaccctatcaattctgaaagtcgcatgccggtagcatagaacatttcaacaatcatatggtcgcgacacccttcaaaaccttcaccaaaatccatatcatccagcaacctatccatctcaccttctctcagaaatactggaagcggttttttctttttgggccccgtaacttttcgtaacggatctaccgcaacctcacctctcctcaaaaggaatttataatatgtccggatagagctcagctttcggtttatcgtattagaagcaagtcctttgtccatcaaggaagcaatccattcacgaacaagttctgcatctacatccgatggagtcaagtccccccacatttcttctccaaacctctgcagttcaagaatatctgtccgatagtactcaatcgtacctttggaatagttccgctcgtacagaagatagtcaagaaaagaatctgtcaacaacatatcgctacatatctaaaatcatgcaacgaatgtatgaaaaagaattcaataattcaaaggaatttacgaattattaatcttctacttgctgaagttgttgaacgtaaacagcacgttctttcttaagtcttttagtcacagacggtttatcgaactgttgtctgcgtctcaattccttaactgtgccagttttttcaaactttcttttgaatttcttcagcgctttttcaatgttttcgccttcttttacaggtactacaatcattttcttttaattaaatgttaatggtttaaaaatctcacgatcaaattgagcggcaaaattacacatactttctttattcacaaaactttctgcaaaaaaattacccataattcctaattatcaaacgaatgagcagagggaaagatgtttttattgagccaatccgctaaaatccgtgaagcatggcaattttttaaaagagaatgtgtaactttgaaagcagagaatggagagattataaactcatttacacgcctacttaattacatttataaaaatatggctcagacaatcaatcaacgtatagatgctttacgggcattgttaaaaagagaaggcatagacgctttcattatccccagtaccgacccgcacctaagcgagtacgtagcaccgtactggaaatcaagagaatggatatcaggttttaccggttcggcaggcacggtggtgattaccaccgacaaggcggggctgtggacagattcccgctattttctccaagccgagcagcagctggaaggcagcggcatcgacttatacaaggaaatgttgcccgaaacgcccagcatcctcgatttcctgcgggagaaccttacagcgaattcagttgtaggtatagacggaaaggtattttccaccacacaagccatagccctgcaagaggatttggcaaaaaacgacatcaccataaagagcattgccgacccgatgaatgagatatggacagaccgccctcccatgcccgaagcacccgcctttatccacgagatgaaatacgccgggaaaagctgcccggacaaactggctgatatccgccgggaaatgaagaaaagcgaagcagacgtattattggtgtcggcattggacgagatagcatgggcactcaacatacgcggcaacgatgtgcattgcaaccccgtagtagtgagctatctgataatcaacgaacaagaaacacactttttcatccagcccgagaaagtaacggaagagctttcagcctatctggaagaagccggcgtcaccatccacgcttatgaggacaccgaatcctttgtgacaaaaataccggacggcagcatcatgctcgacatgggaaggacgaattatgccgtttattctgccctccccccttcctgccgggtacttgacgagcgctcaccgatagccttgctgaaagcagtccgcaatgaccgggaaatagccggcatccacgcagccatgcaacgcgacggagtggcactggtgaaattcctgaaatggctggaggaggccgttcccgcaggcaacgagacagaaatcagcgtagacaagaaactacacgaattccgtgccgcacagccactctacatgggggaaagcttcgacaccattgccgggtacaaggagcatggagccattgtacactacgaagccactccggaaacggacgtgccactgaaacccgagggattcctgctcctggactcgggtgcgcaatacctggacggcactaccgacatcacccgcaccatcgcactgggggaactgaccgaagaagagaagacggactacaccctgatactgaaaggacatatcaaccttgccatggctgtcttcccggaaggtacgcgaggagcgcaactggatgtactggcccgcatgccgatatggcagcaccacatgaacttcctgcatggtaccggacacggcgtaggtcatttcctcaatgtgcacgaaggtccgcaaagcatccgtatgaacgagaatccggtaaccctccggccgggaatggtcacttccaacgaaccgggcgtctataaagccggaagtcatggaatacgcacagaaaacctgatgctgaccgtgaaggaccgtgaaggcatgttcggaaattacctgaaattcgaaaccattaccctctgccccatctgcaagaaaggtatcatcaaagagatgctgacggcagaggaaacggcatggctggacaactatcaccagcatgtatacgagaaactttcgccaagcctgaacgaagaagaacgggaatggctgaaggaagcatgcagtaacctaactactaatcactaaaaaatggcattaataaaatcagtaagaggattcactcccgaaatcggggagaattgttttttggcggacaatgcggttatcattggtgacgtcaagatgggacgggattgcagcatctggttcagcaccgtgctgcgaggtgacgtaaattcaatccgcataggaaacggagtaaacatccaggatggaagcgtactccataccttgtacgagaaatcgaccatagagataggagaccacgtatccgtggggcacaacgtgaccatccacggagctgccatcaaggactatgctttggtagggatgggttccaccatccttgaccacgcagtagtgggcgaaggggccattgtcgccgccggttccctggtattgagtaatacggtcatcgagccgggaagcatttggggaggagtccccgccaagttcatcaagaaagtggacccgaagcaggccaaggagctgaaccagaagattgcacacaactatctgatgtattccgactggtacaaataaagggaggcaaggcccccctaaaaaacagggcgataaagggatgccattccatcacctttatcgccctatcgttatcactctttactcttctaaaagtttatcatactcattatcttatccgtcgcaccggcattgctggtcacataattgcttgcattcatgcctgattcgcgcaaaaagacttcatctgtcagcatacggtcgagcaaagttttcagctcctcataatccttcaccgagaaagcgccttttgtctccagcaactggatggcctcctgaaatttctgatacttcggtccgaaaatcaccggaatgccataaactgcagcctcaagggtattgtggattcccactccgaaaccacctccgatataggcaatctcgccatagcggtaaatggaagagagcagcccgaagcaatcaataatcaggcaatcggccttacggacattcttctcgttggcacgggtatagcgcacataagggcgtttcagtttacggataatctctaccagatggttctcgtcgatgacatgcggagcgataatcaacttcacctccggatgctgattgaagtattcaataaataaatcctcgtccggctgccaagagcttcctgccacaaaagtcatcgtattgttcttgaaaagctccaccaaaggcagacgcttagcttcctcacaaatctgcagcacacggtcaaaacgggtatcccccaccaccgtgacacggctgatgcctatcttcgccagatagcgtttggagcgttcattctgcacaaacaaatggtcgaagtcgcgcagcacatgtctgtacgtaccgccataccacttgaaaaatacttgcccgcgacggaaaatggaggaaatgctgtacaccggaatacgacgcttatgcagttcgtccagatagttcttccagaactcgtacttgatgaagaatgccatgcagggattcacgatatccaggaacttcttcacatttcgaggcttgtcgaaaggcaggtagcagacaacgtctgcccccctataattcttgcggacctcatagcccgacggcgagaagaaagtcagcagaataccgtaatccggatatttggcacgaattttctcaatcaacggccgtccctgctcgaactcccccaaagaagcggcatggaaccatatatagcgcacgtccttctccaactgctgccggagaagttcataaaccacccagtgtcccttcatcatctttcggggcttacggctaaatggagcagccagatgcaccagaatatcgtagatggctattgccaagtcatatagcatactatatggattaaggatgaagaagatttattcactttaaagcatcaacagcacgctgtatacggaccaacgtctcttccttgccaatcagctcggtaatgtcgaacatgtgcggacctttacactcgcccaccactgacaagcggaaggcattcatcacatttcccatgtgatagccacgctcggtaatccagccaatcacaatatcttcggaaggcttggaggagaaatccccgataccgcgcagcacatccatcaattcagccatgatgcggggagtatcttccgaccaacgtttcttcacatcctttgccgcatattccgtgggagctacgaagaagaaacgggtctggtcccacagttcctttacgaagttgacgcgtcccttcaccagtgaaatcactttcgtaaggaactcgtcgctatagttggaggcatctatgccgttagactccagcaccggcctgaaaagacaagctatctccgcatccggtttcatcatgatgtactcatggttgaaccagatacctttcttatagtcgaatttggcacccgacttgctacaatggctcaaatcaaacaatttcaccaattcatccatagacatcagttcctggtcattgcccggattccagcccagcagagccaggaaattaatgaccgcttcgggcagataaccagattcgcggtaacctgaagagacatctcccgacttggggtcatgccactccaacgggaaaaccgggaagcccagacggtcgccgtcacgcttactcaatttgccgttaccctcgggcttcagcaacaagggcaaatgcgcaaaggcaggcatggtatcctcccacccaaaggcacggtagagcaatacatgcaacggtgcggaaggcaaccattcctcaccacgtatcacatgggacacttccatcaaatggtcgtccacaatattggccagatggtaagtaggtagttcatctgccgatttataaagaaccttgtcatcaagaatggaagagtttatcaccacttccccacgaatcaagtcgttcacatgcacatcttcgttcggctctatcttgaaacgcaccacgtactgcttaccggcagcaatcagcgcgtctacctcttctttaggaagggccagtgaattgcacatctgcatgcgggtagaagcatcgtactggaaattcgcaatctccgcacgctttacttccagctcctcaggagtatcgaaagcgatgtaggcttttccggcctccagcagaatctgaacatacttcttgtatatttcccgacgttccgactgacggtacgggccatggtctccaccgaaactcacgccctcgtcaaacgggatgcccaaccacttgaaagactccaggatatattcttccgcacccggtacaaaccggttggaatcagtatcttcaatacgaaatatcaaatctcctccatgctgacgcgcaaagagataattgtataaagctgtacgcacaccgccgatgtgcaacgcccccgtaggactcggggcaaaacggactctgacctttctttctgtcataatctaccttacttatgaatattttagacggcaaaattaaacctttttttccacactaatgtttttttttgtacttttcgcaaaaatttcagccgatatgagttatttcaatacccaaaaagagttctcactcagagatttgctatacagagcactgatattcatcggcactgtggggattattgtctattttctgccacgtgacggtaaattcaactaccagttcgacattgacaagccctggaagtacggacagctcatggccaccttcgacttccccatctataaggccgacgaagtggtgaaacgcgagcaggacagtatcctcgccgccttccagccgtatttccagctggacaaaagcattgagaaaagtgtgctcgccaagttgaaggcagactatcagacccacctgcgcggcctgctcccctccaccgactacgtccgctttctggaaaggaaactctctgaagtatatcgcgccggcatcgtttccaccgaagagttgaaccaactgcataaggacagcacaaccgccatcatggtcattaacgacaaactggccaaccagcaggacatcaacaaggtatattcggtgaaggatgcctataactatatactcacggccgataccgcccactaccgcccggacattctacggcaatgctcgctgaacgaatatctgtttcctaatctaacctatgacgagcagcggacagagaccgccaagaaggagatgctcgacaactattcatgggccaacggcatcgtactgagcggacagaaaatcatcgaccgcggcgagattgtcagccaggagacatacaacatccttgaaagtctacggaaagaatccatcaaacgcagtgagtccatcgggcaaaaacggttgatgctggcggggcaggtactgtttgccagtatcttcatgctgtgtttcatgctctacctcgacttgttccgtaaagattactacaagcgcaagggcagcctctccctgctcttcgccctcatcatgttctattgcgtggtgacggccatcatggttgccaacaacatattcaatgtctatatcatcccgtatgccatgctgccggtcatcatccgggtgttcctcgactcacgcacggccttcatcgcacaagtcaccaccatactgatatgctccatctgcctgcgctatccgcatgaattcattcttctgcaactctcggcgggactggttgccatcttcagtctgagggagctttcacaacggtcgcaactgttccgaacagccttcctcgtcatattgacctacgctgccgtctactttgcttttgagctgattacagaaaacgacttgacaaaaatcaacggaagcatgtacacctatttcgtcatcaacggagtgttgctgctgttcacctatcccctgctcttcctggtggaaaagacgttcggctttacctccaatgtcaccctggtcgaattgtccaacatcaataacagcctgctgcgccgcatgtccgagacagttcccggcaccttccagcattccatgcaggttgccaaccttgcggcagaagcggccaaccgcatcggagccaaaagccagctggtacgtaccggagcgctgtatcatgacatcggcaagatggagaatccggtgttcttcaccgagaatcagtcgggcggagtcaatccgcacaagaatctgggctatgagcaaagtgcccaagtcgtcatcagccatgtgacggacgggctgaagctggccgagaagaacaatctccccaaagtaatcaaggatttcatcaccactcaccatggtcgtggaaaaacgaagtatttctatatctcctggaaaaacgaacaccccggtgaagcccccaacgaggaggcattcacttaccccggtcccaacccgttcaccaaagagcaggctatcctgatgatggccgattcggtggaagccgcttcacgcagtctgcccgaatatacggaagagagcatcagcaacctggtagacaagattatcgattcgcaagtggcagaaggctatttcaaggaatgccccatcaccttcaaggatatcgccaccgtgaagaacgtattcaaggagaagctgaagactatataccatacccgcatcagttatcccgaacttaaaaaataagaactatggaagtgaccagtaaagaacagaaaagagccgaacaactgctgcaaagccagcacatcggactgcaccaaatcaagagtttcagtttcatgaagcgttaccaccaggttccccgcaaaagcaacctggctgcaaaagacaaatacggtccgggcatactgactttacatctaaaggaagggaaagaaaaagcaatctatctgcctcctttccgtcacccttcctcggtcatccgctacctagtctcccaagaaatccccttcgacaactacgcaccgagggaacggacagccgcaaagattcccacagaaacataccagcgcccgtcactctatatgttctggttctttgtcttattcctagtgtcccttatcttgggatattattccgtcagtggcaacgtatggtggggcttcatcccggctatcatttcgtttgcattaagtctttttttcatcagcatgctgatgacccgcttctgttacctgacgctggacaatgacggcctcatcatacacagcgtaggcaggaacatccgctatccgtaccaaaacctaagaaaagtaaacttcgactttgcccgcgaacagaatttcacgcacgtcatggaattgttggacaacgattaccgctatcgtctgttttataccggaagggtttcgaggaaaaagctgaatgagattaccgaacgcctgcaacaagccggagtggatgccacttgcagcctaaacgacaacaaacggttcttccaggatacgtatatcagccactaaacagacgttagccaacaaataagctgccggatacggcatcattcccgtttcgcagatttcagaatgatgcctttgcacttgctctcaatttatttataattgcaggataaacctttttataaataatttgaaaatgagcagaaatgaaattaccttacaagagatgttctcctcagtcattggggaacagtttttttgtccgatagtaaaacaaatgtcagaacaagtcttgactattacattttataagtcattttagcatattctacccctccatcatcctctttctccatatattcaagaactaacttgctgttggatatttcaagaacattcaaatcaagagcataagtggcatcaataggtctaagtgtcagcagcttattactcaatgcccatttcccttcatctaattccgaattatccaaatcatattcagtatatgtaccgtcagctctgaatgtaagattaccaaaatattcgcattcatctttaggtgcatgactccattctctgttgtcttcaggatattctggctctatttcatacccttcttcgtaagttagtacccattgacctacaatgttctctgtagtaggtgtactttcttcttcgtcatcatcactacatgctgcgaagttaacactcataattactgctacgatagccattccaataaatcttaatgttctcatttttaattaataaattaagttagtaatatagtttataaattataaatatttatccactccatttgtacagcgtaccgtcttccgttcatccagcattctcatgtactgcaagttcttggtcttgttgtacatgaacttatcctcatgccaaaggtggtaaacaatacctgcgaacttcaaataccgtttccggcaaccactgttcagcagacgcttgcccaaatcaatatcctcacttccccaaccctcatagaattcatcataaccgtttaccttgataaaatcctcacggaagaaggacatgttacagcccaatgcagccgaacgctttctacggtatctcggagccaagaagcgagccagccatatacaatggattgcattctccggcttgctttcaattcctttcgtccagacatgaatcgggcgtaccataccggacttacatatttcctctgtcagctctttgcccaagtttacccttccacctttcacgtaaatgccacgaccggcttcacggagatggtcggctatcagctttggatgcaggaacacatcaccgtctatctctatgatatagtttcccgtactacgggctacacacttgttgcgcatcatagccaatcggaaacctttatcctcatgccacacatgtatgattggaaacggtgcctgctcttgcagccttgctatcaacgaggcggtctcttccgtagagccatcgtctcctataatgacctcatcgggcagaactgtctgcttgaacaagctgagtaaacatacttgcagagcatcgcaacggttgtaagtagagactattacggaaatcttccccaagtcctttctattcattactaccagatttaaataagttaatcagattaattattaccactctatacactcttgccttcttttatatggatatatggatgaaatggcttgaataagtgcacagagtacacagcataaagctgcacgcaatttgattgattgccacgttagaaatagaactgtctgttttgtgaatatctgtatcgtagccagtgttcccttactgaccgttatacaataaagaagcgtgggaacattgaatattaccaagttgaggctctggactgccttgcacaaataataaacaatgcccacgccagatatgtatatagttcaccctacagaggtgaatatataacactgacgtgagcgtccttgcctattatccttgtgcatgaaattgtccagatttcaacttaggataatatcttaaacgctcttcgttaactaatatgtccttccaacttcccaacgcattaggctgttagaattgctgcaaagttacgaatttacgtttgattggcaagaacttattgtttattaaatgcagaaaggcattcctactccataaatcaaggttaggagcaaatttgtaaaaggtctatataagtagaaatttagaaatttactcccaacttgaattattggcttaaaaggctgttccactccattcttaataattggtgagcgcaaccgccagtaatcaaaaactaaggcagtcataggtattaagtagttcttcctgccttaatcccaagtatctcttggtaattgatacactggaatgattgaatagctccatgagtttgacaagtgcaagctccgaactttcgctgttcatgttatagacctgcctgccgaaagtctttctaaggctgtggcatgagaagttgcctatatgcaacctatacttccttttaacctctttgaggattacatttatcctctgtatggaatagaccgtacctttccggcttaccaatataggcgcgtctatgcctataggactgatatgcttgtagcagtcacagatatgcttctgtagctgcatgttaattctcacagtcctttgctttcccgtcttgatttcgataacggtaaattcctccgcatttaatatctgcttccagcgtaaagccagaatgtcagatattcttaagccagtaaaacagcccagagcaacaagaagcgagattttataattcccgtctttggctaacttccttatcaagttcattgcctcgctccattgcagataatctgcggttgtacttgaatatttaagtgacataacgttcagtcttataatgaaatgaataaaagtgaatatcatttttaagttgaaatatccaacttattgataatcaaagaaacattcactaataacagaagtgaatataataaataaaggacaccaagttaatgatgtcctttgttacgttcaagcctatatgaacggcaaataggcttcatccaatgcaccgctctcaataatctttttgcaaagttcatgtgaggcttgatttctaaggtctgtaccatagctttcatcaccaaccatttgaatgattgccacaatggttctcataagctcctgctgtagtgtacggtgataatacctcgtactctctgcaaaccttttaggattccaactataatcgttcaaggctctttcaagttcttgcgctgccttgtattcgcgactgtcttctattaccatatcttttaatatttaagaggtttataaataaaaagagcacctataccttattatatagatgccctccataccaagctatcctttaacaatggcatagcccaatagcaggatatatcccaccgctataaatggaaacaatgccattgcaatgaagaataccaaagtcgccagtaacacatagaataaattccgtagcataatctccagttttgagaaaccagtaatagagtataattccagatacagctaagaaagaaaccaactgtatctttcatcaccatgcagagcggatgcaatacccgttgccagttctgtagcgttgtaggctctatccagaaagctgtctatgtagctgctcttgttgctgccagtaagcaggttgtagaacttccacatggataggtcactgccaagactgccaaagttatcatcattgatatatgctttggctacactgtttatctgtgtgtcagtaagcagcattctggggatagctttctgatagccttgcggtaacagtgggtaaagcctcattctcccaagtaactggcagaattgatgttctgtcatactggtattgccaagtgtctgcatcagatgtatgtgcttggcagggtcgtacttgttgaacatttccaatacagcacgatacagctcacttgtattagtgacctccagacagctaatataaccgtccgtagatacgcacaagttggtgcatacctggcatgtaaaccctatgaacaccttaaaacgctctgcaccctttttactgtacagattggtatggttataagccctaactccacctacagtaagggtcagcctattaccgttcaccgtctcgtagatggtaggtatttcaatcacgaaagcgcaacgctcgtaataaatggtcttgtcactctccaataactgattggcaggcttatgtattgcttctggaatacgacccttgataacgtgtgacacccttatatccggctgccctatccgttcaccgttaaagaaagtatgtgctgcatcctgcaccgtctcaatgaacgagacgtgcgacagtgtagcctcgttgtctttggcgaatactggaattatacagtcgtccctcaaatgctgtaaggtcgcttcaactgtattagcctctatgaacagaggtcgtttcccctttgtatcgtccgttacaaccgttgcatcctctgcaaattcgcctaaattgcagtttcttctctgtgccatgactggcataatctgtaatgcttccataatctgtaaattattaagttgataattagaaatttctccatctgaatgccatataaatgataatgtacagcactatggcaaacattgcctttggtgctgcaatgaacggtacaatgagtattgcaccaaccgtcagaatagcctttaaatcttccataagcgataatttattggttagtaataagtgaattaaagggaatggcgcgctttataacgtaatgccccatagacttccgcaattgtgctctgtaatacacagacattactgtagtagccagtaataccgtagccaaagcgtttgcggtctggaatgcgattgcgttaaaccgttcatttcccatctaagagaggtgagggacattaggggtaacatgacaattaagcgcataatatacacctcatgcctgctttctggctgataattgcactttatgcagtcttaataactgtatggaaagagtttccgtatctggaagggagggggtattatttagagactgcctaatttgagttggggtatataatgcagcgtattggactttaggatagcaggaatgcccctaaatgcaaataactccatgcccatgaaggttggagctatttattactacatcacaagcatatggaggtagtatattccgagaggctggtatttctgggagggggtctataaagtaagcttcctccgaatttccccagacctcgctaataaagttcgctgattatctttaaaccctccttaccgttgatggtggttcgggtatagttaaagtaatcattcaaagtctgtgccgttactcttttagggggttcgataccgcattcttcataaatccgcttgattgtagcctttatataggtcagcaggtatctgccgccaactttgaaatagtcatgcattaactccgttacttgtggagacttgcatttagccttatagatagccaacttcaagttattggtgatgtatcgcagcttgcgtacttctgcaattcctaacgtatcaaccgcttccactatcagagggtcagcctcatagatgccatccctaaattcatagtcggattcggtctcataaggtaagaccttctccaaaatatccactatcactttcctcttggaaatgatagacttattggcgttacgcagttgcagccattccgcattgcctgctttatacagatatgagcccctaaatgcaaagaagtatctcatcagcgcctcgtctgtataaacagcaaacagagtgtcttcattcagatatatattccttaccattacatcattcacatagttatctaccttacaatacgactttctcttattggcatccagaaatttgttgaacggggaagtctcaagtaatttgcggaaggcatattgagcaccgttatcagtggcattgttaagttcccttcttgtgaatttatagcaaacctcgtatgtattcacttcacgcaatacatcttccttacttctataagtgtaatcattgaatgaattggtaatgtgcgtaatgcggttgagcccgtttctgaacctgcctattatctgtatcatatcggaataggggtccaacaccgtatgctcaaccagatacatgtcggacatcattataaggtcgggcttgtagtccagttctatatccatgcctgcgttaaatctgcttgtgaagaagttgaacttcttcattagtttagggtcgaatttggaatgggcgttcttgaaattcaatgaatactttaacttacggacactcttgggagcacagaatatggtggattcttcaagtattccagccttattcatgagggcgtgaatggcatccgtagagttgaagaagatacagacacaaccgctgtcaaattcatggatagtccgtttgaaacgttccagtgtgttattggtgtattggatatgtatatccacatgatagtcaaattgtggctcaatcaccaacatctggaaatccttgaaccgtgggtcggacagttcaaccggagtggcagataccagtgccttgcctttgaactggaagaagtcgtctaaaggcaagtcaatgctttccctatagtccgcatccttcacgagcttgtgggattcgtcaatcaacatgaagcattcactgtacatatacatatccagctccttgaatgccgctttaaccttgctgaatgattcgggagttaccaagaatttgtaaaacttgccttcggaagcgatgatatactccttaatatcatccactcccactttctcaattacccctatcagattgtcatggacgtgtttcgggtcatcacatttgcactggatggttgacacattaggctcgatgattatggaatggcgtttggctttaatctcgccataggtagcccccaaacctgtcagcgtcttacaaagtaccgtatcggtcggtatctctttaaggatggttttcagatagggaaccttaccgttcttgtctttattcagttttatagtattaatcttcataatggtatatctttaaaatgttattgattgggggaaacaaggagagagctttactggtaactctccccttgagtgtacagattacaacagatgcttatctgccaagtagtccatcagttcgtcggtacgttcaagattaaactctacccgtcctttggggaaatggaatatcgatttgaccttgccatagactgctctaaacaagggaacggtctgtggtttgaacccattatcgaccataagcttgaacaagtccattgtgaagtccttgccttctccataaggctctacatcattgggctctactttcacatcctccgtttcattgttggtcaagtattgcattatcttgagtaagatgtcttggttgagtctcagcttgaatttagatactaccccggtctgaataccaaatgaggagtaaccatccttgtctgtgtaaacttctatagtaagccgttcacctttatccattcttgagagtaattctttgtacgcactctcattgtcgtaggatgcacttttaggtgtgcccagaccttgtaaactaaatttagacataatcttaaaatttagaaattagacattagtttattttgtgaatcgagagtggtgcgcaccgtttgtctttcgattacgctgcaaagttggggatattaggggagggcattagggaataaaataatccacctttatactccccttaagagaatataaaagtggattgcttaattatcagatagttatactatccgtatatggggtttattgtgtttatcttagtatccttgtattgcttgattatcttctttatattatcgtcattgtcattatatgcctcatttctggtcagcttggtgaaatagaccagtttggatatgaacagtagtttgctcttgggagtgtcaccgctcttgccacgctggttatcgaactggggataggcttcaaagaagtacagtagcatttgggtgaacagccatatctgtacggagtctgatgtattgtagccgtttggctcaaaccttgcttgattgaacaaaccatgttctgaaacctctgccaatacttcctcacagaaagccgccatgaatgatatggtattggggttatcgatgattagtcgtttgcctttcacttgtaaacttaatgtcattgggagtttatgggagaaacctattgcatcattaaaatcagcttcattcagctttaccatttcaatgaactttgttatctctcctttggacgtgtcattgaatttccaagtatttaatgccttcccactaacgtaatcgcttataaacagaagtagataccagaatttatcggagtcaatgcccaatgcctttatgatggcttgaatactgtctatattgtcattcctcatatagttgtcataattgaagaatacatttagcttacctgcattgtaccgttgcatgaattgataaggggattgtgacggtaaaagaacagagcttccatcttcttgaatttccatgtctgggtgaaacttatcggcaattacagttacatattccagtaattcctcttcttgccctacatatttatctgttgtgaaattatctattggcatggttaattgtattagtgccgtaaagataaataatgccactccattatgcaacagagcggcattataaattactacagattgtaactactgctttccaaacacgtacttcacgactttggcattagccttgttctcatttacgaaatcacgttcaatatagatgtccgttactttcattgcatcgtcaatatggttaagtgctgcatggactatatatttatcaatgccaactttattaagtgcaatggtagcccaactatgccttgctgcgtagtattccaaatcgtcaatttctaatattgtaccaatttcttttaagccgtagttgatagccttattgaaacccttctcgtcagcataatattgatagaaattgaagagacgtttaccagtcttgtccttgtacttctcaacaagaggcaggactaatctgggtatgtcaaccttcatttgagccttatccaatctacggtctttcgtcttggtacgattatagacgattgtattaccttccatttcagtggcattgtaaaggtctgctgaattgattcccataagacagaatgatagaatgaaacaatcctttgccaaattataacggcaggtagatttgtagcctttcttcatatctttatagggtagcttccatagcttctttataatatctgcggatatggctctctttcttgttgcttcctgcttgggtatttcaaattccatgaagggtgagttggggattaggattaaattcttctccttcttattgtatttcttcttggcttcattgaacagcttcttaatgcttatcaaatatagagagagtgaacgattggaaggtatccgtttaccctgctgcattaatcttttagtccgtatctcgcgttctttattcaagaatgctttaaaactttctaagaagtcaagggtaatcaaattaatatccaattcttccttgccaacaaaccgtaccaaagcattgatggcagttgtataattgggtgctccttttatggtggtagaagctatccactcacgactgaactttataaagtcaatggtttgttgcttctcttgttctccgtttaagaattcaattatctcatctaacgaataatgattttggtctaattgtagtttgaaacactgttctctgtaataaagcaccagtccatctatcgctcttttaatggaagtgtcctctttaaatttgagggatttagttaggtcttttgaagttataaatagattagttgatagtcttttaaccttacggtctaaagtaaatctaatcttaacattgtacgttccgtcaacttttagttcactcttcttgatttcggctttgatagtcagcatgttagtaatgtttaaatcagtcaacaattagtcaacaaatacctaatacaatactaaatataaccaagcaacagacccttaatcggaggtctccatgaactaaaaaaggctctatctcgttagagatgagccttttagtttgtggaccagcctgggcttgaaccagggacctccagattatgagtctgttgctctaaccaactgagctacaagtccgatgcatccttgcttggatagcgggggcaaaagtagcattttctattgaaatatgcaagacttttggataaaattccttataacctttgtccttagaacttataagttcgttttggattcttgggaaaccagccttttttcactcgttcttcctgctcgaatatctccttgatggtccagaacgaggaaaatgcaaagacgcccaaaagggaggctatcatgatgttctccgtataaagggaggcaatgatgccgccgatgccgagtaaaaggaaaatccaccagcacttggtgccccaataatattcggctttcacaactatggggtgaaacaagccgatgatgaggaatgtgcagatacctatgacaaggcccgacagatgatattcgttcaagaaatccattgttgttcgttatttctcggggcaaataggaatctccttcttgatgctctgttccagggaaatcaaggtctcggtagcggttacgccaggaatctcctgcatcttgttgttcagcaaatccatcagatgctcgttgtcgcgggcatataccttggtcagcatggtgtacggaccagtggtgaagtggcattcaacaatttcgggaatcttgcccagctcggcaactaccgtcttatacatggagcccttttccagcttgattcctacgtaagtgcaggttctatatccaagagacttgggatttacatgatagcctgagcccacaataacgccaaggtcaatcaagcgctgtacacgttgatggatggcggcacgtgacacgccacattcagcggctacgtccttgaaagggatacgggcattttgggaaatgatttccagaatctgccggtcaagattgtctattttttccataatagtaaataagtaaagttcttgttgttatcaaatagtaagcaaatataggactttattttaatttatctatgaaaatggacagaaaaatgaataaaagtgaggggtaacgataagacgcggattacgcggaatatgcggatttggtaaactaaatccgtgaaatccgcgtaatccgcgcctaaaagaagtatcaagagggttttgcccctcccttcggattgttacattacttctcgatacccagcagttccacttcgaatatcaaagtagagaacggcttgatttggctaccggtttctcttgaaccgtatgccaggtcgtaggggatatagagttcccatttggagccaacgggcatcatagtgagggcctcagtccagcctttgattacttggttggcacggaaggtagcaggttctttgcgcttgtaagagctgtcgaactctgttccgtcaatcagtgtacctttgtagtttactttcaccttgctgctgtcagcgggaacggcaccgttacccttggtgatgattttgtattgtagaccgctcggagtagttactacaccttctttagtcttgttctcagccaggaacttttcaccggcagctttgttgtcagcatacttctctgcagtcgctttttctttgatggcatccatctgagtgcgcatgtactcttgagctttcatcatatccatggcaccacccttaccaatgacacctgcgacgaaacctgccagcatattttcgcggctgatgctttgtgtagagtcattaccgaagatttgctggttgaaaccttctacccattgcttgctgaccatctggcctacttgcaggccggtcatgtaggccacgtctttcttatcgattttggctgcaccctcgttgaaaccttttaggaattctgacatctgggttgagtcaatgccttgttgtgcaagatactggtccaaaccttctgtacgtgccataccgatggcgtaagacaatgaatcgatgtccgtctttaaatcagctttcggactttgagcagtacaagatgccatgccggcagctactgcaagagccatgagaaatgttacttttttcattttgcttttacttgttgtttatttagataaaattttctgtaattcaacttcgaatatgagcgtgctgtgggggggaatcatctcgccggcaccctgcgctccgtatgccagatcactggggatgtagagtttccacttggcaccttcgggcataagctgaagggcttccacccaaccgggtatcacttggtttacaccgaacgtggcaggctggccgcgcttgatggagctgtcgaacagcgttccgtcaatcagtgtgccttcgtagtggcattgtacctggtcggttgctttggcatagtgaccgacgtttccttctgtgataacttcgtattgaagtccgctgggaagcgtaacaactccctcgcgttttttgttctcttccaggaactttttgccggcttctatgtttgctgcgttcatcttctcctccagttcggcgaagtacttgttgacgatgtcacgggcttctgtgtggctgattgccgtctggttgccctccaaaacgtctttgattgcttgtgcaaagtcatctactgcaatgcctttggcacccatgcttaaaagattctgacctattccaaggccgatagcataactgaatttatccataagattcttttgttgacgaccggattggtttcttttccagtctattgcaaatttacgaatgacaaaagtacgtcttttatttgaatgataagacttttaagtatttaatttttcttatttatatcacaacttgaacattcttcttatatttgtcttactttaataaaggaaaggagcagaaaatgaagaacttggtcatattgtcgggtgccggtatgagcgccgagagcggcatcagcacattccgtgatgcgggcggactgtgggacaaatatccggtggagcaggtggcgactcccgaggggtatgcacgtaatccggaactggtcattaatttctataacgaacgtcgcaagcagttgctcgatgtggtgccgaatgccgggcatctgggcgttgccgacctggagagggatctcaatgtaacggtcgtcacccagaacgtagataatctgcacgagcgtgccggcagtacgcacgtgatacacttgcatggggaactgacgaaggtttgttccagccgcgacccttataatccgcatttcgtcaaggaactggcgccggaggaatatgaagtaaagttgggcgacaaggcgggcgacggtacgcagctccgcccgttcatcgtgtggtttggcgagtcggtgccggagattgaaactgccatccggtatgtggagcaggcggacatcttcgtcatcatcggcaccagcctgaacgtttatcccgctgcgggactgctgaactacgtgccccgtgccgccgaagtgtatctgatagaccccaagccggtggacacgcacgtcatgcgtccgatacatgtcattcaaaagggagcttcggaaggggtaaaagagttgaaggcgctgcttgcagctacccagcctcctttgccttaggacttaatctcctacgtcttaggacttaacccctcacggtataggacttaatatgcagaacatccggatgtctttctccaaaacacccggatgttttacccaaaaacatggggatgttttgccccattacatccggatgttttaggtgaaaacatggggatgttttgggtactcactcctatactgtagggagctgggtatagggggggattcccacaaggtataggtcttgcgggaacaaagtatatttgccctcgaaacttgtgctatttctttatcacggcccgtaatacgaaccaggcatgatgggctatggtactcgccagtccgtaatgccgcgccatgatgcggaagcgttcgcgcagggatgcttgccggttctgggtggtcattccctcttccagatagtcgatgagggtgagatgggtattgtgcaaggtccgtgccttcttcatcacctggatgcaccagtcgaagtcggcggagaagcggtattgcaggtcgtagggttctacaagggaagctttggcaaagaaggcctgatggcagaccagcatgccctgcttgaagcttcgccaggtaagcacttccggggcggcgaggcggcgcatgcggatgaagtggccttccttgtccaccagctccgtttcgccgtacagcacgtcgggtagttcgttgccggagatggaacgcaccatctgctgcaaggtgtcgtcctcgtggaagctgtcgccggcattgaggaagcagaggtaatcgccggtggcaaggcggatgcctttgttcatggcgtcgtacagtcccttgtccggttcgctcacgatgcgggtgatgcggtcgcggtaacggtcgatgatggagagcgtgccgtctttggacgcaccgtccacaatgatgtattccacgtggtggtaggtttgcgagataacgctttgaatcgtgtcctccagtaccgcttcggcgttgtaggtcacggtgatgatgctgaatttcggggtggggtggttatgcatttcttccggtcactttgttgtaaaggtcaatgtatttcttggcgacgacgttctccgaatagtgggagatggctttccggcaggcttgttccgagaggctggggtagtcgggttcggtcagcgtccagtagatgccgttggcaaagtcttccgaggatttgtattgtgccacgtagccgttgtgcagatggtctatcatctcagggatgccgcccacgttgaatccgacgcagggaatgccgcatgccatggcttccatgatggtgttcggcaggttctcttccagcgagggggtcacgaagatgtccacggcattgtagatgttcaccagttggtgttcgttgctgacgaagttcagcgggtagactttgaatggaagcaggttttccagttgttgcgattggttgccgaagacgacgacacccaactgttcccggagttcgggatgcttgtcagccagcagtcggcacgattctatcaggtagtcgatgcctttccgtttgtccgtaatcttcaccgagccgaacagcatgagtttcttgtcttgcggcagtaggcaacggctgcgggcttcctgccggtttcggggcttgaagagattggtgttgatggggttggggatgcatgtcacggcatgcccgcagaagagggcgcttgtccgggcacgttcttccagccagcggctgcaggtgacgaagttgatgtgacggttgcgatacaatgcctgctttttgtggaagatgcggtaggaaaggtcacgtttgcctccacctccgtggatgaaggggcagttgtggcattcctgctggtagtgggtgcactcgcgggcatggtgacagatgccagtgcagggccacatgtcgtgcatggtccagacgacgggcttgcccgaggcgagaatcttctcgatgttcttcagcgagagcatcccttggtttatccagtgcagatggatgacgtctgcttgctggaattcgggcagtgaggtgatgtctgtccccgtgttggcaatgtctacggcaaagatgttcttcttgttgaagcggttggcgctccagatgacgatgcgctcccagacgaacttccacaccatgcgccagttatggtccagtgacacaacggagatttggtcggtctgcttgtcgcgtaccagcagcttggctttgatgccgtggttcttgagtgattccatcagacggctggcggcgatggctgcgccgccgatgcgttcggatgtattgataagtagtactctcatgactgttgttcgtttcttcttttttgaatgttttttcttgttacagatgccggtcttgtttcatccatttccggatacgcttttgcagcgtttgccatatgatggtgaagttgccgtaccgtaggttcaacgccagttcctcgaacgaccgtgcaatctttatccagggatgccgccatgccatgatgcggtaaacgctatccttgtaggctgtgttctcgatgacgtgacgagggtgcttcagtggaaactccacttcgtggcgtttcatggtgaagatgcggcggtaaccgcgcggcatggtgtgcacggagccggcaaagtgggtggagtcggcagtggctcccagattgtttatcatgttgcgggtgggcacgatgctcagacccgaattgaacaacatggaagcgtggaagatggtttcgtaataggctttcccgtgttcgcggtggcgttggcacatgtagatgaagtctttgcggtagcgccgtgtgtggatgaggttcttcagttgccgcatgttctccttgtcgtccaggaaggtgtagaattcatcccattggtccgtcacccgccgccagctcgcccatccccagatggagaaggtggtggcgaagaagtagtcggaagtgatgtcgggtgtaatctcctcgttgttgaatccggcaatcatgctgatgcgtgtgtcgtgctcatacttgtcgagcagttccttgcagaagccgaagaaagagacggcgggcacgtcgtcatcctcaagcacgatacatttgtccgacaaggagaatgcccacttctgtgccatgtattccgatgggtcgcagccgtagttcttctcttggtagttgtggtgtacttcgcattcccagtcgatgtctgccactactttgcgacaagcttctatgcccggcatgtcacgctcgccgcgcgggccgtcctgatagagaaacagtcgtgcggggcgtgctttcttcacttgttcgaatacttgcgccagcagtttggggcggttgaagaaaagaatcagtacagatacatctacaagggctggtttcatggcaattttgttggattaggaggtggctatatggtcatttggtatgttgaaagaaagaactgccggataatgattgtttatcttgtcctgctcttcttctgtataccggtgtaaagtgggatagttgtaccgtagaaagttttccaatccatcaggtgctttcagataaagtggaccgaatttgattggttgtaaatggttgagactcgtctccaaaacatggtcggtagtggtaatcacattgttgtaatacaaagttttccatgagttgaaacaactttgcattatcaccatcaaacggtagattgtctttttagagagtgtcatatcaactatccggttcagaaggcaggcaacagctccacgattggtagggttggatatttgacattttccgaagtgtttccatagccatacctcttttcccatcaggcagcatttcagaaagttgacggcttcatattgtatcttccttaatagcttattgtttggaatacggtcaaaagggaatatatcgacaaagattccctgatgcataggtacatctttaaacatctcttcgacaaacaaggtgttgtttttcttgactttggcaaagtaataaggactatgagggtcggtatgtatccatgaaagaaagtatggttctctcagttcttgggaggctatctggagaaacttattgtagtcttcccgtttcatacctatatctatgtcgtcatcccaaggaagaatcgctttgtcatagagtgcccctattgctgttccgccgattacaaaatagggaatattgtgtttgtcgcagatgcgcacaatctcttccagtatttcgtatagcacctgatgtagttgggtcagttcttctggggtatattgcttcaccatggataccatttttgattgatgtctgcaaaaataatgataatagttgaaaggagcactttccatttcaatcttcttttgcgaaatcggacttgagtttttctatcagtgtgtcggactccccgcttaccactttccggcagaacatctttccagactgctgcaataccggcaggtcctcgagtgtcatcacgcggatggatgcgccgtagtctatgtagtgcaagggggtgagacgggtaagtccggggtattctccctctaaaagaagcccttttgaggcaaaaggggagttgaatacgatggtctgtatgcacagttcgctgggtacaaagctggttctgaaatacttcaccagcttctcctccgtgcacaacttttcatatacatatcgtgcgcagggcaacgtgatggcccaatagtcggaaccgaaatagacatctgcctgcttgccttccaagggtgcaaaaggggctttccggatggggagtatctgtaccagcttgcgcgatgctacgatgagtttgttcttccaccatatactcttccaaggcaggtcacggaaagggtggtaatgggttatcttgtgcaactgctgtttcacggtgcagtgtgtcaggttgaaaccgccgatgaattcagtgtcttgatgctcctcaaaatagcggtggatggcgttgttgctccataatgggtagtcctgcccgctcaggcatactacgcgggtataggggataccgctgtgcaatacggcagcaagcaattctttctggtattccacttgttcccatcctccccagcttatccggtggcggggcacgaaagtgaccttgtctcccaaggcttcttcaaaagggtgtatatcggcattgaggtcgatgtgcacgtagaagtctgcccggtcatccagtgcggcaaccaggcgtgccaagtgtggggcatccttgtaggcggatatgatgtaggctatgcggctcatgctctttttttctttaagaggaattcaatgctttcccggaagatggtagattgtagtttccacaaaaccagtgcataaagcccagctaccataatgattttggctgccatatttaagtataggttttctatgggctgagtggcatagtgagttgatactacgagtacaatggatagggagagataaggagagatgtctttcagcatatcgcgcagtcttaatcctatctccctcttgacaaaacggaaccatacaaatagccagccgatattgataatgacgaaaatacgcagcatccactccaacccgtatgggtatatggcacatacagctactatttgcagcaggctcaagctgatggtgctccacatatagatagaagaatgcccccggctgatgagcaggttggagaacagattgatgacgggaataaatgctccccaaatacataacagttgcaagatatcggcactgggcagccacttctccgtgatagtgataacaatcagttccttcgaaaccaaactcaatcccagcatggcggggaaagagataaaggcggtgaagcgcaacagctttctgaatacggcaagttgccgtgccttgtcatcggcaacacgggtaaagacgggttgtgcaatgccgtttatcatgcccgtaatcgtggtatgtcccatgccgttccacttgtttgcctgcgtaaagttacccacttcccgttccgagtagaacttacccaacaagacggaaaacaaattgttattgattatggtgaagatattcgtaatgattatcttactgctgaaccctatcatctccttaatgggtgtgaagtcgaaccggaagtggggtctccaacgcgagaagtagaagttaagaatcgtcattacggtgatgaaagagatgctttgcaatgcaatcccccaataggcgaatccgttggcagccagtgtgatgcccacaatgccggagactatcagactcgaaatggagatgatggtagtgtccttgattctgagattcttgaacagatacgctctcggtgcgatgctcatgcttgagatgacgaatccgaggaaagagagacgggacagcggtatcagctcgggcgtatcgtagaagtcggcaatcagcggtgcggcaaagaagagtaatatatatatagtagtgctgcacatcaggctgaaccagaacacggcgttgtaatccttgtgcaaagtctccttccggttggtcagtgccgaaatgaacccaccctcctgcaaggcggcggcaatggcggagaaaatggtaagcatccctaccataccataatccgaagcatccagcagacgggcaaggactattccgaatcccagatttaacaactgctgtatgccgttgctgaatcctccccagaagaggcctttggctgttttttctttgagtgatgtatcggacatagtttattggttgataagccaacgagttaacaaggccacgaggcttttccttcctccctgtagccttgttaactcgttaccttgttactgctttatttcacctcgctgcccggtttcacctctttcagcagtgaagtcaccgccagcgagccgtcataattctcggcagagagaatcattccttcacttaccagcccgttcttgaattggcgtggagcgaggttggcgatgaacagcacttgcttgcctaccagttcttccggtttgtagtgctgggcaatgccgctgacgatggtgcggttttccagcccgtcggcaatcttgaacttcagcagcttcttcatcttgggcactgcctcgcattcaagcactgtacctacgcggatatccagcttttcaaagtcttcgaaggcgatggtcggcttgatggggtttgccttgtaggtggcggcttcgtttgccttcttggtggcaagcagcttgtccacttgtgcctggatgacgtcgtcctctatcttttcgaacagcagttcgggggtgcccagctggtgtccggcaggcaacaggtcggtgtgtcccagctctgcccagtcaaagctgtccatgttcagcatcttgcgaagcttctcgctgctgaagggcaggaacggttcgaaagcaatggcaaggttggcgaccaactgcaacgagatgtggagaatggtggctacgcgctccatgtctgtcttggcaagtttccacggttcggtgtcggcaaggtatttgtttccgatgcgggcaaggttcatcgcttccttttgtgcgtcgcggaacttgaatacgtccagtaacttctccacttctgccttgacgtcggcaaattctttcagcgtctcgcggtcgtagtcgttcagttcgcctgcggcgggtactacgctgtcgaagtacttcttggtgagttgcagggcgcggttcacgaagttgccataaacggcaaccagttcgttgttattgcgtgcctgaaagtccttccaggtgaagtcgttgtcttttgtctccggtgcgttggctgtcagcacgtagcgcagcacatcctgcttgccggggaagtcaacgagatactcgtgcagccatactgcccagttgcgtgaagtggaaatcttgtcgccctccaggttcaggaactcgttgctcggcacgttgtctggcaggatgtagctaccctctgccttcagcatggcggggaacacgatgcagtggaacacgatattgtcttttccgatgaagtgtaccagacgcgtttcggggtctttccaccatttctcccatgtgtcgggcagcaattctttggtgttgctgatgtagccgataggggcgtcgaaccatacatagagcactttgccctcggcaccctctacgggaacgggaataccccaatccaggtcgcggctcacggcacgcggctgcaagcccatgtcgagccagctcttgcattggccataaacattgggacgccactccttatggtcttccagaatccattggcgaagccattcctcgtgcttgtccagcggcagataccagtgctttgtctcgcgcattacgggctggctgccactgatggcactcttcggattaatcaggtccgtggggctgaggctggtgccgcacttctcgcattggtcaccgtaagcgccttcggcatggcagtgggggcactcgccggtgatgtagcggtcggcaaggaaggtcttggcttcttcgtcgtaatactgcatgctggtcttttcgatgaattctcccttatcgtacagcttgcggaagaagtcggaagccgtgtcgtgatgcgtctttgaagtagtacggctgtacacgtcgaaggagacgccgaactcttcgaaagacttctttataagtgtatgatagcggtccaccacgtcttgcggggtgatgccttccttcttggcgcggatggtgatgggcactccgtgttcgtcggagccgccgatgaagattacatcttcctttttcagtctcaggtagcggacgtagatgtcggcaggaacataaacgcctgccaggtgtccgatatgaaccgggccgttggcatacggcaatgccgaggtcacggtggtacgtttgaatttcttttccattgtgttattatgtatctcttttgttatgaacgcttttagtggcacaaagatagctgttttctgcaaaatatgagtattcttccagattctttccagatttaggcctcatctttgtcctacgaaacgaacaaatttgatattgataatgtaaaaaatgaaatgactatgaaactggaaaagtacttcttattattggcgttaggcgtgtttgcctttgccttgcaaagctgtgatgatgacgacaacgacggaatctccgtgcccgcggaactgagtaatgcgttggccaaggagcatcccaatgctcagcgtatagaatgggaaacaaaaggtgcatattatgtggccgatttccatgaggacaatttcgagaaggaggcttggttcaccaaagacggtgtatggcagatgaccgaaaccgacctccgttatgcggaccttcccgctccggtgagaagctcttacgagagtagtacctattataatgtatggaaggtggaagatgtagacaagctggaacgtaaggaaatggctgttgtctacatcatcgaagtggagaaaggtaatcaggaaatggacctctattattcggaagacggcattctggtgaaagaagtggccgatgcgcacaacggcggttctcccgaagattatctcccttctgatatttccaccgccatcaaggattttatagcagagaaatatcctaatgcccgcattgtggatattgaaaaagaaaagagcggtatgacagaagtcgaaatcgtgcatggaaatatcagcaaggatgtgatgttcaccgctgagggtgcatgggcctatactacctgggacatcagcaagaggcatctggaggatgtagtgaagaacgctgttatggctgcccatcctggttatgtcattgatgatgccgactttattgagactcccgatggcagttactttttggtagagatggagcaaggggaaagggaaatctacgtaaaggtgacagcggaaggtgaaatactgccatagtcttatacagtgtatttatcgattgcttaccttctaatgtaaagccgttcactgtaaggtgtaacggcttttattccatgaacggtcgttaccttatagtgtaaatggagttactgttggggtaactggagttatcatataaacatattttgcattatgtaaagtgtgtaacgcaaaacgtggaatcattaggtgtgaaacaagtcggcttagaactgagaaatccttttctgatttatggctatgcctctctccgatacttttgcgaccaaacggaggaaacggaaaagatgctttctgcattggagaatggtagaaacattgccttgattactttccagcgtattggaaaaacggggttcataaagacgtgttctataatatgcagcagcgtcaggcgaaagatgatgttgcttgttttttatatggacatatttgccacgcggaatttgcctgcttctgtttgcttgctggcaaaaacagtacttggacagttggatacgcttagtgaaatggtgttgcacaaactgtttttttccgttcttgccatccgatggttagtactgatgagctatacctaccgtatctttgaattttgtactggataagtccgagcagactttgaaggagaatttcgattatatggctgtatcggcgtttcgaaggctatgtctggtatatgcagacattgctgaactggctagcaatatgaaacggtgatcgaggtagggcaggcggagcgggtattggctggggtgctggaagagaatgctccagtctatctatggggatttggctgaaaagtttgccttgaattactgtttatcatctgatgatttcgtctcagcacaatatactccttttcccgaagaagaatttggaaacgtgcatcttgtccatagcccatgccatactcatgcagccgctaagagtgaagacggtagcagtgacaaggaacagtatccccgtagggtcgaaggcaaatacgggtagaaacgctttggacagaatggtgaaaatgggcgagaaaaggagtatgaccaacgtattgcgtcctataaagaaggaaagccgcttggcttgtgccggcagataattgtagactgccaacaacaggctgatggaaagccaggtgatggcgactcctgccagagtacccctatccagattggcgggaaagcagcatagtattacgaatggaacaatggcgaaggttgtggcgcgaaagacttgtgtaaaacgaagcccgctttggctcactgtcatgccgataaggaaatagagggcattggagaagttcatcaatcctccccaatgggaaagggcaaacaggcagacaccggccacaaccagccgggagacaaccgacagccgtacatagcggaatgtgatataatagatgaggctgcacagaatcagtgtatgcagataccagtaaggccccatcggatggaggaatatcttgtcgagtaatatagcaggagtaatggcatctacactttcgcgtacgggcaggaaatgcgacatcaccgtataggccgcctccatgcaggcatacggaatgaaaatccatagaaacttgcggagaaagcttcgggcatccttccggttattggccagatagcccgaaataatcaggaaagcggacatgtggaacgtatagacgatttgtttcgcatacggatacttgtcacctatatatacaaggtggaagataatcatcagggtgatgaagatgcatttcagataatctatctctttgacacggctttccatatggggtagttttctgcgtattgttattgatggcacaaatatatatacttccgtaaacttatttatattttgcaaagggattaagcttattttctcttttaccgattgcttttatgtatggaaaatgtatatttgtgcatgaatcactaacttaatgtaaaaacaactatgataacaagccaattgcttcacccggccagtattgtggtagtgggagcatctaacaatgtacacaaacccggaggagctatcctgaaaaatctgcttagcggcggatataccggtgagcttcgtgccgtgaatccgaaagagactgaagtgcagggtgttgctgcctttgcggatgtgaaggacattcccgatacggaccttgccatccttgccatacctgccgcgctttgtcccgatgcggtggaggtgcttgccgcggagaagcaggtgaaggcgttcattatcctttctgccggttttggtgaggagacccatgagggtgctgtgctggaagatcgcatactggaaacggtgaaccggtatggagcctctctgataggccccaactgtatcggttttatgaactcgtggcatcacagtgtattcagccagcccatcccgcaactgcatccgcaaggggtagacttgatttccagctccggtgccacagcggtgttcatattggagagcgctgtgaccaagggcttgcagttcaactctgtatggtctgtgggcaatgccaagcaaatcggtgtggaggatgtattgcaatacatggacgaacacttcaatccggaagcggattccagaataaaacttctttatattgagagtatcggtgatcccgaccgtctgctgtttcatgcatcctcgctcatcaagaagggctgcaagattgcggccatcaaggcgggcagtagcgaaagcggcagccgggcggcgagttcgcatacgggggccattgccagtagcgattcggcggtagaggccttgttccgtaaggcgggtattgtgcgttgctattcgcgcgaggagctgacaaccgtaggttgtatctttacactgccggaactgaaagggaaaaacttcgccatcattacccatgccggcggtccgggagtgatgttgaccgatgcgttgagtaagggcggactgaatgtcccgaaactggaaggaccggtggcggaggaacttaagggcaagcttttccccggtgcggctgtggggaatcccattgatattctggctacgggtacgccggaacatctgcgcctctgtctggagtattgtgaggagaagttggacaatattgatgctgtaatggctattttcggtactccgggactggtgaccatgtttgaaatgtatgacgtgctgcatgagaagatgcagcattgcaagaagccgatttttccgattcttccttccatcaatacggcaggagccgaggttgctgcttttctggcaaaaggccatgtgaactttgccgatgaagtgactttgggcacggcactttctcggataatgaatgccccgaggcctgccaataatgaaatcgagctctttggagtggatgttccccgtatccgccggattatagattccattcctgcggacggttatatcgcaccgcactatgtgcaggcattgctcagctctgcaggtattcctattgtggaggagtttgtttcggacaacaaggaagaagtgcttgcctttgcacgccgcacgggattcccggtggtggcaaaggtggtggggccggtgcataagtcggatgtaggcggtgttgtgctcaatatcaaaagtgaacagcatttggcattggaattcgaccgtatgatgcagattcccgaagccagtgctattatggtgcagccgatgctgaaagggacggaattgtttatcggtgccaaatatgaagagaagttcggacatgtggtactctgcggcctgggcggtatttttgtggaggtgctgaaggatatatcttccggtcttgcaccgttgtcctatgaggaggcttactccatgattcactcgttgcgtgcctataagattatcaaaggtacgcgcgggcagaagggtgtgaatgaagataaatttgccgaaattattgtacggctttccaccttgctgcgctttgcaacggaaatcaaggagatggatatcaatccattgttggcgactgaaaagcaggtgatagcggtggatgcgcgcattcggatagagaaataagggttagagattagggattagagattaaaggggctgactgttaatcgctcaccgctaatccctaatccctttttcatcctgcccagtcctccctatccagattcctatatccgatagcttccgccaagtgtgccggctgtattgattcgcagtcttccaggtcggcgatggtgcgtgatactttcaatatgcggtcgtaggcgcgggccgaaaggttcagccggttcatggcagttttgagcatggcaagtcctttgtcatccggacgggcgtagcaggcaagcagtttactgttcatctgggcattgcaatatacaccgggaatgtctgcataccttgtttcctgaatttgtcgggcatgtatcacacgctctcgtattgttgcgctcgactcacccgggcgagtgtctgccatcttttcaaaaggaagtggggtaacttcgatttgcaggtctatgcggtcgagtaaaggtccggatatgcgatttagatacttctgtacttgcccgggactgcaaacacagcctttggtcgggtggttgtagtatccgcatgggcatgggttcatggaggctaccagcataaaactggcaggatattccacattgcatcgaatgcgtgatacagtaatttttctatcttccagcggttggcggagaacctccaaaacgctgcggttatactcaggcaattcgtcgaggtataggattccattatgagccagactgatttcaccgggttgggggaaactgcctccaccagtcatggctactgtggaaatggaattgtgcggatcacggaatggccgttttgagataagtccgccacctttaccgagttttccggcaacagaatgaatcttggtcgtttccaggctttctcccaatgataaaggaggaagtatggagggaagacgttttgccagcatagactttccgctacccggggccccaatgagaagaatattgtggctgcctgcggcggctacttccagcgctcgctttacattttcctgccctttcacttctgcaaagtccagttcaaaagagctttgttgggagtaaaactcttcgcgggtattgacttgtgtcggggataatttttgttttccgttgaagaactcaatgacatctttgatattctccacgccgtagacttttaggttgttcactacagcggcctcatgtgcgttcgagcaaggaactatcataccctcaaaccccagctctctggccttaatggcaatggggagtgctcctttgataggttgcagactaccatcaaggcttagttcacccatcaacagatagcgttccagcttatcggactggataacttcgctggcggcaagtatgccgatggctaaaggtaaatcgtaagctgtaccttccttgcggatatctgccggtgccatgttgatgacgatattactggtaggcatccggtaaccgttgacttgcaaagcagatatgatacgttgatggctttctttgaccgcagagtccggtaaaccgactaaatagaacatacagcctctggaactgttgacttcaatggtgatgagggttgcgtcaataccttgaacagccgctccaaaaacttttatgagcacgtttttagtgattaggggttaggatggcaggataggctaccgtcggttttgttttttgagttttttttcactctctttcttctctttttccttttgctctatctcctccagtttcttcttgatgtcttcctcactcatattcttcccttcaatttttccggaagggctaaggaacaggttggcaggcaatgcttgtatggcgagctgcttgatgggcgctgtgttccatccggagaaatcacaactctgttcccacctcagggtatttcttttgattgcttcttcccattcctttctgtcgatgtccaaggaaataccccagagggcaaatagtttgttcttttcttctttcttgtaaatccggcgcagggcagcgttggcttccatgctttgcgggtcccaagatgcccagaaatgtatcaacagatatttgtctttaaagctggtgcgactgatttgtgtacctttggcattgggcaggttgacgtaagggatagttttcccgatggatatcttctcttcttcttggatcagatcaagcagttcgtccacatacggacggtcttttaagcctccggtcatgtttgctgtcatttctttgattaaggcgaagtccggttgcggtttttgcacgaaatatttctccagcagatagatacttaccagtgaagaaggatggttgttgatgaaggcttctgctttttcttccaatgctttctccgagggagtactcaagcctttcaactctttctgaaaggcggttagttcttcattggggacatttcccgtgatttccagtgaagtaagctcggcggcagaaccttttatctttatgttgtctcctttgtccaggtaaagcggatattccgtaccgtcgctgaattgcaaccatgtagaggcaagtgtgtcggtggtgagggttgcagagaacttgtcatccttgacaagcagtgtgtccatacggttatagaacttgtccgtaccatatatataaagggtatcattccccagccctttgatttcaccgcttaggtggactgaattcgtgtttttgctgccgcaggcagacaatataataagcagaaggtatgcaagatagattttcttcattccggttctttttctgatacttcgtcgcgaaaatacttctttttggtgtgaataaaaagaaatgcccgacatatttctatgccgggcacgttcttttcagtctaacctttattatttgatgatattcataaagtcagtgttagtgaagtatttggcgaattctaggtcagaagcagctttctttgccaaagccggttcttttgcaatggcatttttcagactgctggttaccatagatgtattgttggttcttgcgccaagtacagccatcaggtagtcagtgtaagcgtccggcttttcgatagcggccaatgtgctctttgctttgttgtagtccttagccaggatttgtgccaaagctgcactgttggtttttgtatcgccgaatgagttgacagccttgtcgtactgaccttgagcaacatacagattacccaatgcctcgttcagctccttagaaccggaagccttgctcaggtagccttctgctgcggtcttgtcacccttggtcaaagcaatcagaccaagattcatgttgacttcaggagcatccttgatagagagagctttcttgaagtagctttcagccttgtcaagatcaccagcttgataagccagtttacctaagttgttgtaagcacggaaatcgttcgggtagatttgagtagcttttgtgaagatggcttcttgtttggtagcatctttagtcaaggtagtggcatacagcaattcttcgatgttcaactgcttggcatcgctgtcggcgaggcttgcgatttcttcgtcagacttaccgatgatttcgtagttcaaagtcaggcgtgaacgacgcagttgcggcaggatttcgtcggccaaagtcttataaacagaagagatgtttttgatttcttgttctctttgttcaggatcctgatacatggaaagaacgcgaagaatcaattctttgtcttggatgtttgatttggataccagttcctggaaaccttcccagtcttgagctgtatacttggtgtctactgctgcatcgattttggctttcttcaaatctttgttgatgattttagctgtgttgtcctgacggttttcagccaatgtagtattcaagtctacaccaccatcaggagaagcgtatgcggagatttcgatgttgctgatcttcttgttggcagcttcgtttatgttcttcacttctttgccgaattctttggcagtctttaattcgctggcgcgtacgttggcttgttggatcaagaacatgatgttggcgtcatgcttttctttgatgatacgttggaaagcgtcgtcaccgttggcggggttagcgctacccaatgtttgttccagcatctcagaagtggaaattacaccgtcagctacttttacagcagggatggtgacagtctttttaccgattgtagccttgaattccagatacagttcggattttgccatttccggtacatagtcgaaagatgttttcatcgtgtagctgccgcccatcttgtaagagatagtctggtcgttaccttccactttttcgccttggaatacggcagattggcccttagcttcgccaccgttccatttcaatactggagtcacttctaccacagccttcttgttgaagtacttttcggggaattttccgttgattgtagcgggaactttaccacctacagcctccagaacttgaggagttacggtgaaataatcagatgacaattcacccatttttttgctgcatgatgtcattaatgcaacaaccattgccattaaaaacggcagatacaatttcttagtcattttaggtataaattaattgtttgtaattgaaatttgtctattccatgttagtgtgctgtttgggcatgaacataacaacgcaaagatattaaatcctattacagtttgttaaccctcgcagtaattttatcataatttaatgaatttcccgttctttgcgatactttatattgcggggatggtgttctatgatttcactgcgcaatctgttccggtcgatgtgtgtgtaaatttctgttgtagcaatggattcgtgccccagcatactttgtatggcgcgtaggttggcgcctccttcaagcaggtgagtggcaaaggagtggcggaaggtgtgtgggctgatgtttttggtgatgtcggccttctctgccagttctttgataagatggaataccatgatgcgcgagatgtttttgccccagcgtgccagaaatacatagtcctcgaagtctttcttgattttccagcctccattacggtctacgaaccagttccttatttctttgatggcacgggacgatataggtacaaggcgttgtttgctgcccttaccttctaccttgatgaagccttcgtcgaaatacaagtcggagattttcaggttgcacagttccgatacccgtaggccgcaactgtatagagtctcgaggatggcccggttgcgttgcccctcgtttgtgcctaggtcaatggcggagatgatgcggtctatctcttccaccgtcaatacttctggaagcttgaatccgattttgggaccctccaacagttcgctggggtctccttccaggtagtcggctatgactaggaaatggaaaaatgacttgatgcccgacaagatgcgtgcctgcgagcggggatggatgccgatgtcgtgcagtccggaggcaaaatgctgcaagtcatccagggtagtgtcaaggatagcgataccctctccttccagaaagtgcagcagcttctgtaagtctgtttggtaagcatccactgtattgggtgagagtgctttttccagtttcagatactggtggtactttctgattatcagcgtttgtttctccttattcgtggatttttcttctgatttcatttcttttttctacctttgcttcgcgaaaatagactgcatttcagcaaattgcaaataaatttgcatctgctttcggtttgcactatctttgcaccgcaaaggtataaaaaattgtgttatgaggatacagattattaatggccccaatataaatctcttgggcaaacgtgaaccttccatttacggtagcgttacttttgaagactaccttgccgaactccgtaagaaatatgcggatgtacagattgactatttccagtccaacattgagggagagctgatagacaagattcagcaggtgggttttgatgtggacggcatcattttgaatgcgggtgcttacactcacacgtccatcgctctgcaagatgctatccgttcggtcacttctccagtgattgaggtgcatatctctaatgtacatgcccgcgaggcttttcgtcatgtgtccatgatttcctgcgcttgcaagggtgtcattctcggtttcgggctgaactcctaccgtctggccatggaggcattaaaagattattaaataaaataggtatatagattatgttattgaagcaaacgaagattgtcgcaacgatttctgaccagcgctgtgatgttgattttataaagcagttgttcgatgcaggtatgaatgttgtacgtatgaatactgcacatcttggccgtgaaggtgccgagaagttgattaataatgtgcgttcggtttccaaccgcatcgctatcctgatggatacgaaaggaccggaggtccgtacgacggttctggctgagcccattcctttcaaggcgggcgaccgcgtgaaggtggtaggcaacccggagcaggagactacccgtgaatgtatctcggtatcctatccccatttcgtcaaagacttgaatgtggacggccatatccttattgatgacggtgacttagagttggtcgttgtagagaagacccccgactatctgctctgcgaagtacagaatgaggctactctgggcagccgcaagagcgtcaacgttcccggcgtccgcatcaatctgccttctctgacggagaaggaccgcaccaatatcctttatgccattgagaagaacatagacttcattgcccactcctttgtgcgcaataagcaggatatactcgacatcaaggcaattcttgacgctcataacagcgatatccgtattgttgctaagattgagaaccaggaaggcgttgataatatcgatgaaatcctggaagtagccgacggtgtgatgatagctcgcggtgacctcggtattgaagttccgcaggaacgtattccgggcatccagcgtgtgctcatccgcaagtgtattcttgccaagaagccggtgattgttgccacacagatgcttcataccatgatttccaatccgcgtcccacccgtgcggaggtaacggacattgccaatgccatctattatcgtacggatgccttgatgttgagcggtgaaaccgcctatggaaagtatccggtagaagcagtgaagacgatgaccaagattgccgcccaagcggagaaagacaagttgtctgacaacgatatccgtattccgctggacgagaacagcaacgacgtgactgcgttcctggccaaacaagcggtaaaggctaccaccaaactgaaaatccgtgcaatcatcaccgacagttacagcggccgcactgcccgtaaccttgccgctttccgtggcaaatatccggtgttggccatctgctacaaggaaaagactatgcggcaccttgccctttcctacggtgtggaagctatctatatgcccgaacttgccaacgggcaggaatattactttgcagccttgcgccgcttgttgaaggaaggccgtttatgtcctacggacatggtgggctacctgagtagcggtaaggaaggcacacagacctctttccttgaaatcaatgtcgtagaagatgccttgaagcatgctgaagatagtgtgttgcccaacagtaacagatacttgtaggataagggattaaggataagggattagcggttaatgattaattaataattgtgcgcagaactaacccctaatccctaacccctaatcccttatccctaacctataatccattaacaaagtgacgattgacgaatacattttgcagcacattgatgatgagggcgattacctgaaagcgctctatcgcgacacgcatgtcaagttgctatatccccgcatggcttccggacatttgcaggggcgtatgctcaagatgtttgtccggatgattcgtccccggcaggtgctggagatagggacttatagcggatattccgcactttgcatagcagaaggactgccggagggcgggatgctgcatacgtttgaaatcaacgacgagcaggaggacttcacccgtccgtggctggagaattccgattacgcggataaaatcaggttctacatcggtgatgctttggaactggtaccgcaactggacctcactttcgaccttgcctttattgacggagataagcgtaaatacatagagtattatgaaatggtgctcgcccgtctttccggcggtggatatatcattgccgacaataccttgtgggatggccatgtgctggaagaacaaccccatcgcacagacctgcagacaatcagtatcaaagccttcaatgatttggtggcgcgggatgcgcgtgtggagaaagtcattcttcccctgcgtgacggattgacgattatccgtaagaagtaactgtttttctatctttttctcagcagccgcttgctgaggtatctcaccggataccatacggacaagaagcctacagtgatgaccgttacgaataccagaataatatccgtggcatgtacacttaccggataagcgtctactacaaaacttccgtttcctccccccaatgaaatcaacccgaaacgttgctgcagaaagcacagcaacaatcctaaaacgatgccggagagggcgccgaacacagaaatcatcctgccttcgaacaagaagatgcgcgctatgagccggtcatcggcacccaggttgcgcagtgtctccacgtcctcccgtttgtccagtatcagcatggacagcgaaccgatgacattgaagcatgcgatacccagaatgaaggtgaggaagagataagagatgagtttctctatttccatgatgcggaaaacatcggcctgctgctcgtagcggttctgtacaatgaaccggtcgccgagaatgcctgctattttcttttgtacggagccgatgttggaaccgggtttcagtttcatctcgatggcagagacttccgtgtcataattaaacagacggcgggcaaagtcgagtgacgtcagtatgtagcgtgaatcgtatttttgctggttgacggcaaagatggcgccgggcgagaagagatactcccggttgaaagccgcagtggggttggctatgtttacccgtacgttccgtttgggggcatagacctgcaacgggtctacgaactgaatgccggtgcccaactcggatataagttccacacccagaaaaccatagtccaccaccgagtcgctcagtaggaactttcccgtcccatagagcaagctgtcgatggaggtaagctgttcgaaattgtcctccactcccttgatgacggccattgcctggcggtccttgtactgcaccatggcattctcttccagtgtttccgtccacacgtcaatctcggacagggcgtgtacttgccggatgcacgcttcgtgcgggtcgaaaaccttaccttcgcggacggtgattttcagttccgggtcgaaagctgtgaaaaagcctgccaccatgtcctgaaaaccgttgaacacggacaaggtgcataccaacgccaacgtagccaatgccactccacacaccgaaataccggagatgatattaatggcattgtgtttcttcttggagaagaggtagcggcgggctataaagaagggaagggacattatttcagcagttcgtcaattcgttccagatagtccagtgagtcgtctacgaagaacttcagttcggggataatgcgtagttggtggcgtacgcgggtacccagttcaaagcgtatggacttcatgtttccgttgatgttcttgacgatttcttcgcttttctccgaggggaatatactgagataagcgcgtgccacgctcatgtcggggctgatgcgtacggcactgacggaaatcagtatgccgggcatggacttggtttgcaacaagaagatatcactcagttccttctgcaggagacgggctattttattttgtctggtagtttccatactgttcatttttttatgctggggtgcagcctgttttcacgttagcaaagttactgaaatatatcgttctgccgactgtttatagcttttttttcattcttttccctattgtagggttcattcttttccgttctgtcgatgagatatgccttttcgtagattctatttgttgttcttgttatgcttccctaactttgatgtcagttcggagaactgctgatgatgagtgaagaaggaagagaaccattccgttatagaagagactctctctaaatagcgttttttcatgtattattgacttgagccgtttttacccgggagggtagaaacggtttttttgcgcatctgaccgggctttcttgtctcttgcataggcttccgttgtgtgttacataggcttctgttgtgttttgcacggtggtttgtcttgagaagcctttgggtttatcatgtgcgcacggctgtggtacgccttttccacagtcgtgaagaagacgtgccacagctgtgaagaatatgcttcacagccgtggtttttcatcaatatataggggttgacagaacagacataagggaatgacagaacaaacatgaggggataacggaacggacataagcactcgacgcattccgctattcataccctgatacggcatgcgtcgagtgcttatgggggaatgatatgatattttttttatgcctttacatacttccttttagctatcagcactgccacgatgatacctatcaccagcagtgccagtgctccgtaggcgatgccttccgtcacgtgcaggctggtggggtcaaagcgcatttcgatggtgtgctgtccggcaggaacatacattgtgcgcaggatatagtcggcgcgtgccagttcggcaggctgtccgtcgatggttacgtgccagccgtccggataatagatttcggagaatacggcaataccgtcttgggcattgtttgtttcgtacgtcaggcggttaggtgcgtaacttgtcaggcggatgctggagaggctgtctttataactttccgtggtacctttcagtacatccttgaagcgggcatccactacggctgtctctgtgggtatgatgctgtccagggcgtcaatctcttcgttggcgttgttcacatactgcaccttgtttacaaaccatgcattgccgtaggcgtgcgggttgaggatgggaacggtttgtctttgctgccctgcagggaagatgaagtatttggtgttcagcatgttcagtacgcggaacttattggcatctacgctgtccatctcacctccggcggtggcaatggccttgtaggccgcctgcatttcgggagagatatgatgctctatcatttcctggtagcggcgcagcttggccgggtgataaccgccgacgcttttgtgccagtaggaggtattgttgtcatcgaaggtgctggtggcaaagttcaacacacgatagtccaagctggtatcttgcagtatcagctcgtctgtattcgtcttggtgaaggtttccgtacggatggagtggggcacgaactgggcatcattcagatagcgcttgttgaccccccacatatctgccaggcagagtatggtgatacctgcaatggtcagcgagctacgcagcttgccgcttgcatagagccagagcaggctgcagccgatgcctatgatgatgaagctacgcagggcgtcgctgctgacgagttcggcacgcatctctcccaagttggcaaggatgccggagagttcgttggcgggtatcatctgctggttgacggcattctgcagcatctgtgcctcttgggcgggcacgtagccggagccgatgctgcccggggcaacggcaagcagcagggcgatgcctgcagtgagcagcaggctgatgccgaggggcttcttttcctgctttaagatttccggctcttcgagcaggcgtttcagggcaaagatagccagcaaaggtatcgtgaactctgctatgacaaggatggaggacacggcgcggaacttgttgtacaacgggacgtaatcgatgaagaaatccgtcagcggcatgaagttcttgccccaggacaagacgatggagaagaaggtggctcctatcaatgcccacttcaacggtcctttcacgatgaagcatcccagtacgaacagaaataagacgaatgctccgacgtagacgggacccgacgtcatgggctgggtaccgaaatattgtgtcagtgagccgtacagactgctgtacatcgggtttgccttgctcatggcggtttcactctggctgagagcggcggatgctccgcctttgaagttgggcaccagcagagtcagtgtttcgtcgatgccgtagctccactgggtgatgtagtcgcggtccagcccgctactggtctgcttagcagcgtcgccggtctgcaccagttcgcttttgccgcgcatggtttctttgctgtaggcataggtgtgatagaggttggatacgttggcggctatgccgacgagggctgccacaatcagtacggcacttgccttgaagaactggggcaatgtcttggtacgccatgctttctcgaagtaggctcccacaaagaaaaggatgacgaagaagaagtaataggacatctgcacgtggttcgaggtgatttgcagggccacgaacaaggcggtgaggatgcctccccacagcagtttcccacgataggcgagcacaatgcctgctatggtgggcggcacgtaggcaagggtgatgaacttccagatgtgtccggcagatatcaggatgaagaaataggacgagaatgcccacatgataccgcccagtccggccagccagaccggtatgccgaagacgcgcagcaggatgtagaagccgagcatcagcatgaatgtgaggcacacatagtcgggcaggaagagttggtaggctttctgtacccactgcagtgacttggtggagtcatacgaaggggctatctgatacatgggcataccgccgaacagcgagtttgtccaacggctgcgttcgcccgtctgttcgtaatactccttgacttcttgtcctgcccctgctcctgcagccgtgtcgtgctgaaagagaatacggttttctatatccgccgggaagaagtaggcgaaggaaaggaggacgaatgccaagatggcaataaggtcgggaagaagcttcttcatgagttataagttatgagttatcaattaatcaattgtggggcaaagatagtgcaaaccgaatacagaactttcatgcttgcatgaaaaagttttgttgaggtgcagcctatcttcgcttttgtggcaaagatacataaatgcagattgttattgtcacgttatcggcagaatgttgtacctttgcctttccaaaaaaagattaaagtgctttaatggtaatatgcaagcttaaattattatagatatgacaatagggataatcagtgcaatggacagcgaacaccgccggttggtggagcgcttgcaggataagaatacgtcgggcgatggtagtttccgctatgtggaaggtacattgggcggtaaccatgtaatcttgacgcaatgtggcatcggtaaggtgagtgcagcggtaggagcttcggaactgatacggcgcttttctccggactgcatcgtcagcaccggtgtggcgggtggtattgatgcttgcctgaaggtgacggatgtagtggcaagccaacgtctggtgtatcacgacgtctggtgcggcgacggtaacgagtacggacaggtacaaggtttccccgcctcttacgagggctgtccctctctgttgagacatgccttgtcgctgaacgaagccggaatggaaagtcgcatccacagcggacttgtctgtaccggcgaccggttcatcaccaaccgtatggagctggataccatcaagcaacgtttccccggcggtcttgccgttgatatggagtctgccgccattgcgcagacttgccatctgtacaatgttccttttctcagcttccgcatcatcagcgacacacccggagtagaggaccatgcttcgcagtatgccgatttctggggaaccatggcagagcgttcattcctcacgatatggaccttcctctccacccttcccagcaatttataactcataacttataacttataacttataactcatgaagaagattcccagttttacaatcgaccacatccgcttgttgcgcggcatttacgtatcccgccaggatgaagtgaacggagaaacagtcactactttcgacatccgtatgaaagagcccaatcgcgagcctgccttgggacaaggtgctctacacaccatcgaacaccttgccgccacctacctgcgcaacgacccgcagtggcaggacaagattatctattggggccccatgggctgcctcaccggtaattatctgctgatgaaaggtgacttgaagccgcaggacatactgacactgatgcaggacaccttccgctttgttgccgaatatgaaggtgaagtccccggtgccgctccgcaagattgcggcaactacctgctccacgaccttccgatggctaaatgggagtctgccaaatacctgcatgaggtattggaacagatgaaagaggagaatatgaaatatccggaaaaagaagaaaaataaggggttaaggataaaggattagggataagggataagggataagggattattggggtcgcatagactttaatataggcataaccccatccttgatccttatcctttattattacacaatctcaatcccttgctccttgcaaagttgcaatcccaagtctttcagcttgaatttctgtatcttgccgcttcctgtcatggggaattccttgatgaagaagatatacttgggtatcttgtagcgtgatattttgccgatgcagaaatctcgtacatccgattcgtgcatatccactccttcgtgcaggatgatgaaagcgcctacggcttcaccgtactttttagagggaatgccggctacctgcacgtcttttacgccttccagttgatagaggaactcttctatctcgcggggatagatattttcaccaccgcggataatcatgtccttgatgcgtcctgtgatgcggtaattgccgtcctcgtcctttattccaaggtctcccgagtgcagaaagccgttctcatcaatgacttcggctgtggcttccgggtttttgtagtaacccttcatggtgttgtatccgcggttgcacatttcgccttgtacgcctacgggacactcttctccggtttcggggtcgataacctttacttccgtatgttcaaagtcgtgtcctacggtattgcaacgtacatcgaacgggtcgtctatccgggtggcggtcattccgggagcagcttcggtcagcccgtaaacgctggtcactttcatgtacattttctcttccacctgcttcatcagctctaccgggcagagggaacctgccatgatacccgtacgtaggctggacatatcgaacatgtcgaacatcggatggttcagttcggcaatgaacatggtgggtacaccgtaaagtgccgtgcagcgctccttgtggatggaggcgagcactaccaacgggttgaagcgttccaccattacttccgtacagccgtgtgtcaggcagttcatggtggcaagtaccacgccaaagcagtggaacaatggtacgcagacgcagagcttgtcgtcggcggtaaacttcatgtgctcaccggtaaggaaaccgttgttggcaatgttgtagtgggtaagcatgacgcctttcgggaatcccgtagtgcctgaggtgtattgcatgttcactacatcgtggcaagtgacctgacttttgagctcattcaggcggctgtcttctatattgttgcccaagagaagtatttcggccgtgttgtacatgccccggtgcttctcctgccccacgtagatgacatttttcatataggggaaacgttcgcttttcaggtgtccgcgttggcaggtcttcagttccggaagcatggtataggtcatctgcacaaagtcactgtccttttcgccattgacgatgcagagggtatgcatgtcggagttctggcagagatattccagctcggactgtttgtagttggtgtttaccgttacgtagacggcacctatcttggcgcaagcgtataatagggtcagccagtcgggtacgttggctgcccagatacctacgtgtgttccccgctccacgccgatggcgataagtcctttggccatgtcgtccacccggcggttgaactggctccaggtgaaacgcaggttgcggtcggagtaaacgatatattctttgtctggtgttgtttcggcccaatgttccaaccattggccgagggtgcgttcgtataacatgatgtggaagttgaaagtggaaaggtgaaaatagaaagtatttatcattttccattttcacctttcaattttccattaatttaaattggtgtataaactactgcaagtatcttggctgcctgcccttcataggcgtgtacgtggtgcggaacgatggaatcgtaatagatgctgtcaccttcttcgagcaggtaggtgtttttgccgtaactgatttccatggtcccttccatcaccatgatgaattcttcgccttcgtgtgaggagagtacaaagtcactgtcgtccgtagcggccacatcaatgataaacggctccatgtggcggtcggctttggatttggagagtgaatgatactccatatgcttgcggctgtggatggcattgttggagaaactgatgctgttctgcgattcgtccttacggcagaccacgggaccgttctcatcctggtcgtcaagaaaagttcccaaacgtacacccagtacacgagctatcttgatgaggggagccagtgacgggaggtcgatgttgttttctatacgttcaatctgttcgatagcaagtcccgaacgctgtgccagttcttccatactgatggattggctttcacggagtgattttattttttctcctacaattttgctggtatccataatgatagtattttctgtctaaaggttataatttatagctattaaaccgcaaaaataagagaaacttttacttgatgcaacattctgagggaaaatattgctgaaatatatccggtggtcggcttatttgtataatattcttctgttctgtttctctttcttccccaaagttctgtttatagccgctttaagtcttgttccgatacgtgctttcctttgtacgctttgcctgccgcattgaagcgatagcttaggttcagggagaagctgcgcgagtccgggtttgcctttttcgtataggtcagccggggaccgaacagcatgaaggagccataccgggaattccacaggtcattgacttgcagtccgagcgtcagccttttgttgaagaatgttttgcggatgccggcgtctatgccccaataggaacgttgcagcatggcgccgaagttgccttcgctctggtagtcggcatcaagggagagagtccactcgtccggaagctggagactgttttgcagaaagaggtaaatgctgccgcggttcatattcttgctactgccttgattggtgactttgaagaacggttgggcgaagtagatgccgagctccggtttccagatgccgacggtgggtgacagatgggcagaggcggtgagatactgcatccgtttgaaatttccggtagtgaagatgacaacatccggattgtcctcgtattctttggtcatgaaggcaatggcattgcggcggtattggtagttaagtccgaattgtacccacttgtaaagggccgtgaactgcaggtcgtggttggtttcgggggtgagcagcgggtttccgccttcgtagatgaaacggttgttataactcagtgtgctacgtagctggaagaagctggggcggttgcttttggctgtatagctgagattggcttgggctttgccgagaggaaagtctaccgataggttggggcaccagtcattgtaagtacgactttgaccgggcacgtactcttcctgctcccaatagtcggagacggcatgctcgaagcgcagtcctgcaagaaggctgatttttcctaatgtcagtgagtattcggcaaagacggcggacttgctttcgtcgattcgactgtctgtatcgggaagtatgtgctgccggttcaggaaattgtcatttcgccggatgaaggtgtaatcggcgccggtcttcagttcacctttccaaaggggatgggtcagaatcaacttggcggcataaaggcggttgtcggcgtggttgaaagagctgatgtcgcgattgccttcggtctggctttcttcttgagcctcctggtgattataacttttgccgtataccaggtcggtgttgaagtttatgtagagttgctttatgctgccctgatagtaggcattcagctggtgccggctggtttgctgcaagttttgagaggaatgtatggtgtgatcggccaactcttcattcgcccggacggtatatgtcgaatgatcactgctgtgataatcgggggtacgatgaaactcataggaggcaccgaggctgtgttggggggtgaagtcgtaactggcgcttgcttttcctccggcaagcagtcccttattatataagtgaccccggttatttacatcccattgtatttcggacggtatctggtagcgaacctcctggtggcgttttctgttttcataattggtgtacagcatgcccagtagggccagtcctttcttctgataattcagattgacttgtccgtaatggctgctgcgtctccgttgggtgattcctgcacggaaattaccgccaaaactgtctcttttgttacgtacggtgcgtatacgtacaacggctttaacggtagcatcgtactctgcacccgggttggtgatgagttccactttttcaatatcggcggcagagaggcgttgcagctcggagttgtcttgcagaaggcggttgtctatatagatgaccggtgtccctttgccaaaaacggtatacccctcatcagaggagcgcagtccggggatatgtttcaatacgtcgttggcatcattcaaggatgcgagcagggtttgccgtacgcttgtctccaactttccgccctttagtcggaaaacgggacgggcggcggtgatgacggtttccgcaagtagcacggcatcggtttgcaatatccagttgtgggtactcccggtggggcaaggctggcaaagggttttgtaaccgatggaagaaatttgtagtagatagtttccgggagcgggagggagaagttcaaaactaccgtcgcttcggctacacgttccttgtatgaaggtggaatcttcggaaaggagggcgatgttggcaaactctatcggttgcttttcctctgtgagaattttaccttggatggagggtgttgccgggctggtttgtgcttttgttgtcgtgacgctcattaggagcagggcaagaatacatattatctgtttcatgttccggttgttgtttgatttcgggacacgaaggtatccgctttctgccgggatggaagaaacaaaaagcggatagttgtctgacatttgcctgacaatagactgacaatactttcttttgtccttttaaagggggaagatgattacttttctgtatccatctctccggtgaacgagatggactgtttgttcatgggttgcacatggatactggtagaaccatcgggaaagatggtgaggcggtactcataattgtcttcatcactacgggtcttgaagtctatttggattttgccttttttgagtgctctagttgtgtatgcggtgatggatgcattgaaattcaggttcttgcctcctccatacggagcattgtaggccactccaaagtaaggcaggtaagagaaaacggagtcgtttctgatttccagtgtgtagttggtggtcaggttacgactaccgcctctcatcggttgcatccgatctacgttgattttgtattgtttagcagcaatagcttcttttacagcacgttcagtgcgcgctttcttttcgttacggttttgggcggttgtcggcattgcgacagtcaggcagattagccctaataggataagtttgttagtcttcatgattctataatgtttaggtttttatttccagtccgtaggcgcggccacgatctgttgttattctgaggttgctgttgtcctcgacaatgggcttcagacgccgtatcaatgtgtaaagcgtttcgtctgcattgtcttttcccggccatagcgattggcagatgtcggatttgaaaagtaggtgtgaggaagaaaggtagaacatctccatcagtgtgtactgcatgggggtgagttttagcttttcctgctgttcgttatagaagcaggcttcctggagggaaagcgaaaggttgccgaaagtgatggtgttttcctgctgttgcccgttacaagtatcagcatcagtccttgtgcgccgacggaaatagaaaaaggtgaatcctccccagaggagggcggccaatagcaatgttgccggaattgtctgcttggataaactgaacagcatggcagctgagcagcgggcatatcctcggaaagaaagcgtcagtccagatgcatcggctgtggtggagagccatactaatgtgtcgctggcaagacatccggcaggaatttcattgaatacggtggcgggagcattctttttcagtatatgcagcgaaagtgtggagacatctttcaatccggtgacggacaatgcttcggtaaaggctctgtgggaaccgcttacggaaacgggagtacccatcacttcttgcaacttggcataggtttggatggtgtccgcattcaaccataatcccttgttctgcaatactgtgcgttgcagtgcctggttcaggtcagagaccacacgttgttctgcctgcgaatagctgtgataaccaaagccgaatgatagcagtatcaatagaaaagtgattgctatcgaaagatttgctgctgatacttttcttttcatggatacaaaattaggtataaatcggattataaacaaaaaaggaagtttccttttggaaaacttccttttttgatggttttgccgcaagtagattacttacgcaagccgagttctttgacgatagcacgatatctggtgatgtcgcggtccttcagataagtcagcaacgcacggcgtttacctaccaacatagtcaaagctctttctgtactataatcctttctgttgagcttaaggtgctcagtcagacgagcaatacggtaggaaaacaaagctatctgagcctcagctgagccagtatcagtgttagactttccgtatttgccgaagatttcttgctttttagcagcgtctaaatacataatgtttaattaaaagttattataaatattccctttcggggctgcaaagatagggataaacttttatatcacaatgatattcagcaaaaaaatcatatctatactgcatatctaatccaaaatcactaactttgtcgcctgaaaataataggtattatatgcaaaagattagaaacattgcaattattgcccatgtggaccatgggaaaacgacgctcgttgacaagatgcttttggccggaaaccttttccgcagcaaccagagcacaggtgaattaatgttggataacaatgacctggagcgtgaacgaggtataacgattctctcaaagaacgtttctatcaactacaaagacaccaagattaacattattgatactccgggacacagtgacttcggaggtgaagtggaacgtgtattgaatatggcggatggatgcattctgcttgtggatgctttcgaaggtcctatgccgcagacacggtttgtattgcagaaagctctgcagattggtctgaaacctattgttgttgtgaataaggtggataagccaaattgccgtcccgaagaagtgtacgagatggtgttcgacttgatgttcagcttgaatgcaaccgaggaccagctggatttccccgttatctacggttctgccaagaataattggatgagtaccgactggcagcagccgactgataacatttatccgcttctggactgtatcttggagaatattcctgcccccgaacagttggaaggtacaccgcaaatgctggttacttcgctggattattcttcgtataccgggcgtattgctgtgggccgcgtgcaccgtggcacattgaaagaaggcatgaacgtgtctttggcaaagcgtgacgggagtatcgtgaaatcaaaaatcaaggaactgcatacattcgaaggtatgggccgtgtaaaggtgcaggaagtgtcttccggtgacatctgtgcattggtaggtatcgaaggatttgaaatcggagatacggtctgcgattacgaaaatccggaggcgttgccgcccattgccattgacgagcctacgatgagtatgctcttcaccatcaacgactctccgttcttcggtaaggaaggtaagtttgttacttcccgccacatccacgaccgtttgatgaaggagttggataagaatcttgctcttcgtgtgcgcaagagcgaggaagacggcaagtggattgtttccggccgtggcgtgcttcatctttccgtactgattgagaccatgcgtcgtgaagggtatgagttgcaggtagggcaaccgcaggtaatcttcaaggagattgacggcgtgaaatgcgaacctatcgaagagctgaccatcaatgttcccgaagaatatgccagcaagatgattgatatggtgacccgtcgtaaaggtgaaatggtaaagatggaaagtgccggcgaacgtgtaaatcttgagttcgacatgccgtcgcgcggtatcatcggtctgcgtaccaacgtgttgaccgcttccgccggagaggccatcatggcgcaccgttttaaggaatatcaaccgtataagggtgagattgaacggcgtaccaacggttctatgattgccatggagtccggtacggcttttgcctatgccattgacaggttgcaagaccgcggtaaattcttcattttcccgcaggaagaggtttatgcaggccaggtagtgggcgagcattcccatgacaacgacttggtgattaatgtaacgaagtccaagaagcttaccaatatgcgtgccagtggttcggatgataaggcacgtctgattcctcccgtacagttctctcttgaggaggcactggagtacatcaaggaagacgaatacgtggaagttactcctaaatcaatgcgtatgcgtaaggttatcctcgatgagcttgagcgtaaacgcgcaaacaagaactgataaacagaagagttttagttgttatatatgaaaggagtgccccgccgaaaggtgaggcactccttgtttattgtcgtcattcaaacgaaagtcaatcgatgaattttacctttgccgcattacggggtttggcagcgggcgtttcatccggatagccgaaagcgatacagtaaagtagctgatagccttccggaatatccagtttcttcaggtattcggcagcagccggagtagaggtcatgaagcgcgtgggaccgcccaagcagcaagaaccgattcccatggaccaggctgatagaatcatattctcacccagcagtccgcagtcaatctgcgaaaggtcataagacgggtcattggcaataaatactactgtagaagcgttgcgaaacatgttcttgaatttcgggtcttcggcggctttgggattttccttcttgtagatttccgtaatgccgttgatgaaatccgggttatccactacacgcacttcccacgattgcttgttctgtccgttgggtgcattgataccgcaatccaggataatctgcatggtgtcgcgattcacggcttgcggtttgtactggcggatactgcggcgtgacatgatggtttcaatcaccgcattctctttgctttcatttgcattggcaacttgggtctctttctggacttgggcaccgcaactgcagaacagcaacaaacttgcgcctgccaacatcaatctgatacttttcatattgctttatttgaataatggtttctgcaaaactactaaaactttcggattatcaatgagatagagatattaaaaaagaaaaaaggcatctcccggaggagatacctttttcatatgtttctaactttattgtcagattagagcttcggaccagcagcaaccagagccttaccagcttcgttgccagtgaacttagcgaagttcttgatgaagcggccagccaggtcttttgctttttcttcccattggcaagcgcattcgtaagtatcgcgaggatcaagaatcttcggatctacgttaggcaattcagtaggaaccacgaagtcgaagaaaggaataaccttcgtcggagccttgtcgatagaaccgtcgaggatagcgtcgatgataccacgagtatctttgatagagatacgtttgccgctaccgttccaaccagtgttaaccaagtatgccttagcaccaaccttgttcatcttcttaaccaattcttctgcatatttagtaggatgcaagctcaagaaagcagcaccgaagcaagcagagaatgtcggagtcggttcagtgataccacgttctgtaccagccaacttagcagtaaagccagacaagaagtagtactgagcttgttcagggttcaggatagataccggaggcaatacaccaaatgcgtcagcagacaagaaaattacctggtgagcgtgaggacccttagaaaccggtttaacaatgttattgatgtggtagataggataagaaacacgagtgttttctgttacgctcttgtcagcgaagtcaatcttgccgtcagcagcaactgtaacgttctccaacagagcgtcacgcttgatggcagcgtagatatcgggttcgctttctttatccaagttgataaccttagcgtagcaaccaccttcgtagttaaatacaccttcgtcatcccatccgtgttcgtcgtcaccgatcaacagacgtttcgggtcagttgacaaggtagtcttaccagtaccggacagaccgaagaagatagcagagtcagtgccttccatattagtgttggcagagcagtgcatagaagcgataccacgcaacgggttcttgtagttcatgatagagaacatacccttcttcatttcaccgccgtaccaagtgttcaagataacctgttcgttggtcttcaagttgaatacagtagctgtttcagagttcagacccagttccttgtagttgtcaacttttgccttagaagcgttgaatgatacgaaatcgggttctccgtagttagccagttcttcagcagtcgggcggatgaacatgttagttacgaagtgagcctgccatgccacttccatgatgaaacgtactttcatacgagtagcggggttggcaccacagaaggtatcaacaacaaacagacgcttgccgctcagctgcttaacagctttagctttcaagtcagcccaagcttcttcagagcaaggtttgttgtcgtttttgtattcttcagaagtccaccatacagaatctttgctggcttcattcattacgaagaatttatctttaggagaacgaccggtatagatacctgtcattacatttacagcacccagttcagttacctgacctttttcaaaaccttccaaacctggtttggtttcttctgcgaacagtacatcgtaagacgggttgtggataatttccttcacgtcttggataccgtacttgcttaaatctaaatttgccatttcttttaatgatttaaaatgttggtatttggtttataatctctttccttaatctctttttacctttgatttacaagggaaaacgggtgtagaaaagctctttttttcctgcttttcagcaggtcccttgtttttcgcctacaaaagtaatactttctttttaaagaaaagctctattagagaaatttttctctaataggaaatcttttataaaaccataacaatatctgctaactgaatgttgcaaattgagtgaaattcgtttactttgcagcagattttaatgtgctaatgtgctgatatgccaatgtgctaattgccatgcggcattacgtacaccacatttgcacattagcatatttgcacattagcacatttatagttatgaaggttatcaactttgccgagacaaattctgtcttgaaccaatacgtggcggaaattcgtgatgtagcagtccagggcgaccgtatgcgtttccgccgtaatattgaacgcattggagagataatggcgtatgaaatgagtaaggaactgacgtattctgtcaagcaggtacagactcccttgggggtggcgtcggtcagcacacccgatgacgaggtggtgattgccactgttttccgtgccggattgcctttgcatactggattcttgaatatgttcgaccatgccgggaacgcttttgtttccgcttaccgttattataaggataaggaatgccgtacggtggatgtacacatcgaatacatcgctactccggatttgtccaagaagacattattgattgtagacccgatgcttgccacgggagaaagtatggaattggcctggaaggccttcgtcaccaaggggatgccggccaagttgcagatagcttgtgtcatagccagccagcagggcgtagagcatctggaaaagctgttccctggagatgaagtgaccttgtggtgtgcagcaatcgacccggagatgaacgagcattcctatatcgttcccgggctgggagatgccggagatttggcgttcggtgacaagatataaggttcatatatcttttccatcagccttttcccaagtgcgggcctataatgccccggttcataataattgtggatgtctttcgtgtattcgttgataccggtgaaatcaaacacattccgttttccgaagaagcgctttagcgtctttacgtcggcagggtttatgttgacctgcaggtagtcgggactgataatgattttcacatcggtattatgcttccggcaaatccactttatttcctgcaacaagctgatttgcttttccctgagcacttggggggcttcccggtatttcccgtctctataattcttcattttctctttggtgaattctcctttccggttttcccagtacttatctccctcttcctttatcattttctctctgggattcagcacatcattggttaccgggtttcgggtggagccataggggtttataatccctttcatgtaagggcgataggtatggaacagcttgtagtccagataggggaagagaaagttcgggtagaagaaggcttggcagaattccttctgaaacttgaagttgcttattcccgatatggcgggcggcagaatgttggaatgtccggtcaggcagcggtcgttgtgcaatgattccttgtcgataatcagcagcaggttcttgattgttgcacctgccttgtccagtgccttcagcttcaggcagacggcggcgaggctttcggcatttccgaatagccgtacggcccttccgccgtggaggtatttctcccattcatggcattgataagccatagtgcaggagtttcccatgatataggagtcgatggggatggtatcccggttgttcagatacatctgccaccccacgtacccttcgtttagtacaaccggggtttggtcgtatcgttcatagttcttcaggaccatgaaagggtcgtccaggaaatagactgccagtagggctataaaagggataaaaaggataaagagctttttcatgaaacgtatggctgcgttccgttcgctgtttttcttcatcatgtgtctttattgtcaaaattgtaaatatatgaagctgtccgagttgaactgtcccagtgtgaaaagtattatggcgagcagataatagatactccatcttacggctgtcggctgtcgtccgagggcttccagcaaatcatgcttggacatgaaatattcgtaaaccaatatcagtacgagtgcgcttcctgccacaatgctgttgtggtccggcattccgatgttcatttccttccaactgtaatgtacgccgaaggagaggtggctgatgtagtggaacgcttcggccatggaacttgcccggaagaatatcagagatacggcaaaaagtaggtaggtccttacgacggataatgtggcatataagcggcttcccaattgggctttcagtctgcggtgaaatgtcgtggtcttcatctcgtagaagatgatgacaccttgaattagtccgtagacagcgaagttccatccggcaccatgccagatacccagtcccgtgaaggtcagcgccagacttagaaatacgccccattgtccccatccacgcaggctcgaggacaacgggaggtacagatagtcgcgtacccagaatgaaagcgacatgtgccatcggcgccagaagtcggcagtggtctgtgcaatgaacggccggttgaagtttgggctgagcttgaatcccagcatgcgcgctcctcccaatgcgatgtcggtatatccggagaagtcggcatacagctctatcggatataggaggcatgccatcagcaattgcacgcctgaggctgtgtataccgacccgaagacaccgtctatgtatggggcgatggagtcggccagtatcagtttctttatcagtcccacgacaatcagtctcattccgtagaccatggatgcatagtccgtagctttgcaggacttcagttgggggagcatgtcacctgccctttctatgggaccggaaaggaacttcatgaagaagagcatgtatatcatgaagtcgggcaggctcttttccggttcttcttcttgccaatagatttctgtcaggtacgaaatggcctggaaagtatagaaagagattcccagcggaaaaaggatgtggcagtctgtaagccggtcggcataccggaatgccaaccagctcacgaccagaaaacacacacctgaaaaataaattcccttcatgctgctttcccgcttggtctgtcctatccatttgccaaggtagaaggtggtaagcgtgaggatgagggccgttatcagaaaagtgaggtggtagaagcctatgaagaggcagctggctgtcagtaaggtcgcttttctgaatcgtgaaggaagcgtatggtatagaatgaaagtacacgcaaacagtacgacgaagttcagggatatgaatgacatttcctagttggttttggttaaaatggcatggcagatgtctcccacgtttttgagttttacaatatctctgaaggtgaagcgtacattgaatttcttctctatcttgtttatcagttgcatgttggtcagtgaatcccatccttccacatcctgggcggtggtctcattgtcaagtacaatgttctctcttttcagtacctcccgaaagatgaggctcatttcattcaaaatagtctgtgtatccattgtcaagtttaaattagttcttgtattttctttctgtctgttttgctactggtgttcagcggaaactgttccaggcaatgcatatgcttgggaatcatgtagtagggaagcctgctatacagatattcctccatctgctgtttgtcgagctgtttcttctctacgacgagatgtagttcgcactgattgccgttgtcgtatttgggaatgacgactacacggcattcaccgttgaaaaagttttttgccacatgttcaatctcgctcagctcgatgcgaaatccttgtatctttatctgtgagtcttttcgtccgcaatagatgatgtcaccgtcggcatccatccggcagaggtctcccgtcttgtagtatacttttccattggcggtctctacgaggcattccccgtttttttcgggagcattccagtatccacccatcacttgattgccgctaatccatagttcgccggtttctccggtaggcagcgggcgaccgtcgttatccataattagggcatcgatgccttcgaaaggccttccgatagcggtcatgccgttgtgatgcttgcaggaggtgacgggtatccggtaggcagtgcagtagatggttccctctgtcggtccgtataggtttatgaaagaggcattggggacacattttctgaaagcatccaacagctccgcgtcagaagcctcggcagtaaccactagatatctaagtgcggggaggtgtatctccggaaaatagggacgtagcagctggagcagtgaaggggccacggcagcgaaggtcaggtcgtatttttccagagtttcaattacgttgatgtatttcacgccttccggagaaacggtgtatatgcaagcacccagcgtcagcggatatagaaaggatacgatggaaacgtcgaaagtgagttcgaacatctgcagcatccggtcgttttcgtccagttgccagtcgaggcggtggtaggcggtatagaaagcatttaggttacggcgggagatgggtactcctttgggttcgcccgtgcttccagaggtaaagatgatgtaggcattttcctcttctgccgtatggaggatgtcttctgcggcatggaacgtggcggagttctctgcctgctctatttcggaggtacatatcagttccagattccgggtgtcgaggttcaagatatggatattctcggtatgcagcacgaggcgaatgcctgccgagtcggcaattctgtcgttcctatgtttggggtaggaaggatggaggatgacgtatgtctttccgcaaatcagtgcagatagtatggatgcgtatgtttccagtctgttttctgcgacgatgccgataattttgtcttctctgtccttgaatagggaggatattttctgtacgcaagttgccagctctccataagtgcaggccgtgtcttcgatgacgaatgctggtcggtcggcatatttgccgaaggctttcatgatgtcgccaatcaagtcatttggatattttttcatttagtccgttatgttatagttcagtttttgcggaagcgatgtttgtccgtcgtttattaaagacagtggtttcccgcaatctccctaccgggaaatccttaagatttctaaaaaaggagggatactgttcggaataaaagaaacagagggggcaaatacatactcaccacaggatagcacggattaacactgctaaaaactctttattatcagaactcctaaggcaatctgtgttaatctgtgttattctgtggtgagtatgatatactcttcgggcaaaatgggtttgcaaacaaagtccttattttgcccagaacagtttgtggtagtaagtgtcttcggccgacacctctttatagtagggattgtagttgacttccgtattcgggtatctccagcggttcggcacatttgtgatggtaccggctacttcggggaagaccaggccggacggatagccggtacgtcggatgtcactccatgcctcgcgactggccaggaaaccgaaatgcagccacttttgggtaatgatagcatccagcttgtctgcatattccgtgctgttccatttggcagcagcgaaagaggctgtttcttcggcagtgggggcattataccggcgtgcgttttcacccgtacttaccgagtcgtaatagtagtaaagcgtgatggactggccgacagcctttttgaactcttcttccgctttcgcttcattctttgccactccataccccatttcataggcttccgctttcaggaaatggatttcgggtgaggccattatcagcatgtcgaatttatcgttttcccaaaagaaacctttctgcgtgatttgtgagaaaccggtgttgctggtattgacttcgtcttgtgcctgcgagttgtaatattccgtcagctcatccgccacggtgaggtctgtgcccagataacggtgctcgtccaattgaccggtgttttggttggtaatcttcacgggattgaagttgagcaggatgcgcgggtcgtcttctcctttcacataaacgccgctcagtgggtcattgctggtcatatcatagttgccatggcccagcatgcggtcgatgatggcgcccgaagcgagtcggttggttacccagtcacccagtccgtggcctgcggtgaagttcagttgcccagacttctggttgacaatgagaatgttgttttcttgttcctctatcaacggataggccgacggattttccaggatttccttgatggcggtacggccttccgcctgcaagtctccctgcgcggctacgcgcagggcaaggcgtaggcgcaaggagtttgcataacgttcccatttgtccatgtccccgttgttgataaagtcttgtgtattgaagttcctcggtgtggggatggagcggaaccgcggagcaatttctttgagctcgtcaagaatggttttatatatattctcggccttgtcatagtgagcatacgatttacctacatcgttggtaagcggcagcgtgcaagcttccgagaaaggcatatccccgaaaacgtccactgtggcggcaaagaaatcgtacaactgtactttggcggcaagatagaatgcctcgtcctgggcttgttctgccgcgctttcttcctcgtagagagattccagcttacggaactgggccagtgccgaatacacattgtcccactgtccgtcaatagcgggtatatagccgggggtatacatatccgtagtgttggagtagccgaaggtttgtgcatacttgcccgtaaactgtgaatcgaatccgaagaaccggttgtattcgtaaacatcatagtcctttactttttggaagactcctaccatcagattactgatggtgacttgggttactttggaggggtcttcgtatttgctgtcgaagtcataatccgtacagcctgatgttgtcaagaggaatgctcccaatgaaacaagagataatatctttgtctttttcatactctttgttgttttttggatggttgttttgtcagaaacttgcacgaagtgaaacaccgaaactgcgggtagctgtggtagaacttcccacggtagcctggttggcccaggatgttccgacggacgactccgcatcgtagtttttcagtgctttgtagaagtagaagagattacgtccgaagaccgacacactcagccggcccagtcccagtttggagatcatcttttcgggaaattggtagccgatggtcaattcacgcagtttgacataagaattgtcgaataccgaatggcggtatgtcagctgttcggcctccgttccccaattataggtggtgttgtagtaatagcctgccggaatgatacgtgtgtttctttcgccagtggaggccactacacccggaagaatgatgccgtcgtggtagattatctctccgttggggccggcacccgtggaagggtctacttgtaccggaattccgctggaattgttgtcgcccggatagtaataggatagtccgccgtgttccgtatcacggtactttagggattcgggtgtcagacccactgcggtggcatattggttcatttcgttgatgacatctcctccgatgcggaagtcgatactgaaatcgaggaatacattcttgtaggagaaagagttgaatagacctcctacgcctgctggattgatgttgccgactttctgcaattcggtttggttgaggtaaagacctttatcggaaacgaggtactcaccgttttcgttcacctggggaacctgcgcatagatgtcacccattggctggccttccacagcttgtatttttattccactgcctccggagttgagtatttccagatagggcactccatcggccagtttcaccactttgttcttatatacaccatagttggctgtcaggtcccagcggaaatctctggtcagtatgggagtggcactgattgatatatcccagccgtggttggctacctcgcccacattcatcaacacattctttacgcctgatgtggaaggttgcggcgtggagagtatctggtcctttacacggttgttgtagtaggatatatctatacccaaccggttgtttaaaaacttgctttccagacctatctcgtattcgtacttcttttccggacggatatctgcattcccccatgaagagggaatggtgttccaggtgaatccgttgtctgaaccttgctcgtagacgatattggcggtataggtttcaggagcatttcctacgataccgtatgagaggcgcagttttccatagttccaccatgacggcatgtggaaggcttgggtgaagaggaaactcagattagcggaaggatagaaaaagctctggtcttttagggtagacgagcgttcctggcgtccggtcagttcaaggaatagatagttgtcccatcccaggctcagtgtacccatatagccggttttcagtagttccatacgttgcagggtactgcttggcgtgtagcggctggcattgaggtcgaaccagttttccgtgacaagcccgccattggtggagaccctcatattgttcatattttcgtagcgtccggtccagcctacggtggcggcaatgtcgaagcggttgatattatagttgaagttcaacataacatctccatagacaatgtcgtaacggcggttgatggactggaagctaccgttggggtcgtatagggaattgggttgttcgctttcatatttcagtgtttgcttcacatctgtgatatcagttgaaacctgggcgcgcagactcagccagttggttatctgccaggtggggcgaattataccgatgagccgattctctgtctcgtcgctatggtgatggtacatattccacagcatgttgttcactccggtggcgtaactggggtcgtaggcccatgattcctcaggagtcagcgtggcgtttcctccgacaaaggtattacggtatcccagactggtgacgtagctttgtttcagatagggaatgtccaggaaggtggagaacatgttgccgaaaccgctgtataggttgagcgaggtttgcggacggtcttctacattctgtacgatgtagttaagggagtattccagtttcagcggtttcgccagttgatacgaaccggtcagcttgaagttgtgtttggtgaagcttccggtcaaggcattgggaatctcgtccatgaatgtgtaggagaagcggttgctggtggtttccgtcccttgtgagatggcgagattgtaagtctgggtccagccggtgcgaaacaactctttccacgggttgtcggtcagtgcctggtaggggcgcatcttcccgtcccagtaaagtacctcgctaccgtcgtatttcgggccgaaggacaaggtggtggaacggaggcttttgtagctttgtccgtttagggttctctgatagaagcctcccgtctgtttctcataatcgctgtatgcggtgttgtaggttcccggcccgtatacggtctgtacttttggcagataagccggtaagtttgccatgacttgggcattgaagtccaccgtcagcttgccacttttggcgcgtttgctggtgatgactaccgcaccgtttgcagcctccgagccgtagagagctgtggcggaagctcctttcagaatactgaggctctcgatgtcctctgggttgatgtctaccagaccattggaacggatttgtccgtcgttgccaaattcagcgaagtccgtgcttttgcccgtgccgccgttgcggatgggtaccccgtccagaatgatgagtggctggttatttccagtgatagaggtcaggccgcgtacgttgatggagacagctccggcagaaccgccctgtgtttgtgtaatgcggactcccggtgctttaccgtacatggcagaggcaaaattgggtgctcctgcctttaccaattcgtctgcactgatggtactgatggcataaccgacacgtttcgtatcttttttgatacccattgccgttactacgacttctttcagttgctgggtatcttcgctgagtgtaatcttcaggtcgccttgcttttttcgttttgccaggtttatctcccgggtggcatagcccatgtaagcgatagagagtgttgcatctgcaggaacggtcagtgtgaagttgccgtccacatcggtaatgacgccgttgttggtacctttctgtatgacgctggcaccgataagcggttctcctgttacatctctcacaatgcctttaatggttcggttttcttgtgcgaaggctgttccggtgaaaagaaatgctaataaccaacttgcaataatcaaacttttttggaagtgcgacactgaatgtggaatgtcacaccgttttctcatcctgattttcatactactgaaaaataattgatttatcttattataaatattacgtcctttcggcggatattttagcaagagatatgccaaacgaaaggcaagctatcctttcaaggatgaataatgttgataatcaatcgtttatttttaattgggaaaagggaagttcgggtgtttgtggtgtggagatgtggaaaaaatccacagtaggtattccacaatttccttctcttcccttgaagtcttgttgtcggcccttattggtagccttgttcgtcggaggtatgttctatcgctgtaataaaatctggtgcagttgcagtggttgcattttcttttcagggtgggagtgcttttgacctttatctgggaaggattactcgaacgaaggaaccatcagcctgcggtttgtgagagaaaggataggtaggtactcttacttttgggaaattaatatcatgtttgcaccttatttgtttcgtgcaaacataatattaataagaaatgatacaagctattaatattgcaactcaaaagtgtggaagcaaaatgcgcttccatacttttgagttgcttccacagcatctgaaatgccgttggataagaaatttcggcagatgagtggaagtgtggaagcaacttatgcaaaaatcttagtggtttattttacttcccacgtatcgttcgtcatcaataactcctcgaagttgtgatacttcttcttggcagacacctcttcgatttgttcatgaacggcatcgtcgtaagtaggagcttccacatcgcggataacaccgagtgcaatcgggaagtcgggaccttccattagggcaagctttagttgcagggtgttgtccatgcagtgggcatcgtggatgaggatatccttctctgtaatgccgttctcaccgagtttcacgactttcagaccaaagccttcctgcatcaggccgtattcgttgttctcgccgaagaacatcggttcgccatgtttcaggtagatggcattcttggagcggtcttcctttttggctacggagtcatgcgtaccgttattgaagataacgcagttttgcagaatctcgcaaacggaagcccctttgtgagccatggctgccttcaatatttccactgtccccggagcatcggtagctaccgcgcgggcaaagaaacggccacgggcaccgaaacaaagctctgccgggtggaatggatcttctaccgtaccgtagggagacgacttgctgacgaaaccacgcggagaggtcggggaatattgacctttggtcagaccgtagatgcggttgttcagcagaatcatgttcaggtcgatattacggcgtacggcgtggatgaagtgattaccgccgatggccagaccgtcaccgtcgccggagatttgccataccgtcaggttgggattggcaaccttggcacctgtagagatggcagcagcacgtccgtggatggtctgcatcgcatacgtattcatataatagggcagacggctggagcagccgatacctgagatgacggcattctcccaaggagctttgccgatttctgccattgctttgtgcagtgaggccagaaagaagtggtcaccacaacccggacaccaacgaggttgtccttttttatagtcttttgctgtatattcgcacataatctttttaaattgatagttgataattgatagttgataattggtggttggtcattgataatccgcatattacgcatggttattatcaatagttaacagtcaattgtcaattaatttattgaacgctgccaccagctcggcaacgacgaacggctgtcctttgacttcgttgaactggtacggggtgaagttgtctatcttcatacgtagataaccggcaaattgtccgaggttttgttcggcaactaccaccttcttgtacttcttcagaacagcctccgtgttcttggggagtgggtttagataagtgaagtgggcgagggcaaccttcttgcctgccttcttcatctcttccatggccgaatacaagtggccgtatgtaccgccgaaaccgacaatcagcaaatcggcatcgtctgcacagccttgcacttctacatcaggtacggggattttggccaccttctcggcacgtaggtggcacatcaagttatggttttcgggatcggtggagatggcaccggtattgctgtctttctccagacctccgaggatgtgcatatagccttcttgtccagggatggcccagtagcggacacccgtttcaggattgcgtttgtacggagtatagttgtccttcatttcgggagtcacatagggaggagtgatggcgggatagtctgccagtttgggcagcttccaggcgccggaaccattggcaacaaagccgtcggtcagcaatacgaccggagtcatgtgttccaatgcaatcttgcttgccatgtaggctgcatcgaaacagtttgtgggtgaagaggcagcgatgacgggcattgggctttcaccgttgcggccgaacagtgcttgtaacaagtctgtctgctctgacttggtgggcagaccggtagaagggccgccacgttgcacgtcgagcacaaccagcggaagttctgtaatgactgccaggttcatggcttccgatttcagacagacaccgggacctgaagtggaggtcacagccagcgcgcctgcaaaagcggcgccgatagaagtggcgcaaccggaaatttcgtcttcacactgcacggtcatcacgcccagagacttgtgcttagagagttcgtgcagtacatcggttgccggagtaatgggataggagccgaggaacagcttcaggccagccttttcagctgcggcgatgaagccgtaagcagtagctttgttacccgtgatatccatgtatctgccgggaacggtggttttactttcaatcttatatgtgtgggctacggaagcatgggtgttgtgtccgtaatcatatcctgcatgtataaccttgatgtttgcctcggcaatttcgggctttttggcgaatttctcgcggatgaaatcttcggctatctttaggtcgcggttgaacagccaacataccagacctactgcaaacatgttgcggcatttcagcatggatttgttgtccattccggtgtcggcaaggcagtctttcaccatctttgagatgggggcggcgatgacatcctgcttaatacccatttcctctatcggattatcggtcttgaaagccgccttttccaggtctgatttctgaaaagcgtctgtatcgataatgatacaagcagtggatttagcaaacttatattgggttttcagtgcggcggcgttcatcgctaccaatacgtcgcatttgtcacccggggtatagactttctcagcaccgatatgtacttggaaaccggaaacaccggtaagtgaaccttgcggggcgcggatatctgccggatagtcggggaatgtactgatatcattgcccacggtagccgaaactgttgaaaagatgttgccggcgagctgcataccatcgccggagtctccggagaagcggactaccacttgctccagttctttgaccatcatgtcgtttgccataacttacgaattactatagattaatttttgggggttactgtattctatcactgaccgacaaatttcgtaaagttaatcggattaacaaaacttttttcggaaaatcgacagaatacattatctttgcattcgcaatctactgcaatatgcagaatctatgcaaaaggtcttgtagttcaacggatagaatagaagtttcctaaactttagatccgggttcgattcccggcgagactacaaaaagaggttgtgtcaaaatgctgacacagcctttttttatgcgcaaagcccagacttatcggctgaaaaacagccgataaaattgtcgtggcggaaaatagaatggttacaaaattgccaccgaaagttcgtactttcggaaaaagatgttatatttgtaaatgaaagagttatttgacagcatagcaacgcaaaacgctgaaattcgcactattgctaaatcgttatttctatttctcaaataattcgctaaaagtttatttctcaatcggttaagtcaaaccgagaaaaatctaaaataaaaatatttccttttactgatttttgcagatttatttttataacatactatataatagtgaaacagaaagaaaagaaagctcgaaataggaggacaaatgaacaaatagacaaggatgtaatatccgaacttgaaaagcttgtagctgaatatggttttggcaatgtcaatttgagtgcattgatgaaagctgcaaacatagaagccaatgtgttttatagaagatacggctcaatggaaaacctttacgacaggcttgctaagcagtatgatttctggatcaatgatgctattgacgtttccagcctgaacatatttggacctaaaaagttttttgcggaaacattcaaaaccctttataggagcttgtctgataacactgtaatgcaaaagttgttgctttatgaaatgtcggttatcaatgaaacgacaaagagaacagcagaaacacgggatattatgaatttaaatttgattgcgtattatgacaatctgtttaaaccggcgaaaatcaatattaaggctattatggcaaatctgattggcggaatttattatctgatacttcataggagatgcgcgaaaacctgtacaatagattttaatactcaggaaggggaaaaggtcttttttgaatggatagactttctaacagatgtcatttttgacaaactggaagcgtatgaaaggaacagaaaagcagctcaagaaatgttatctgacggtataagtgaatttaaaatatgcaaatacatgggtatcaataaaaatgacttgagaatactgctttcaaaataaccatagaaatccacgagagctttcaacagagtctaaaaagtacatataagtgattatggacttaatagtttaatcagatcattggagcaagggatatttgacgttagctgttgtaggctcttttataatttttttctatatatccctttgtataaggactgacagcctgctacaagaaaaatctgacacgctttgtgtagcgtgttacataaagtgcgtcaagttgttttttcaaaggacaaacacgaacagacttgaaattgcggataatgatataagtatatcactattcacagtttcaaggtagtctttgtatcttagtccggctgtccgttctccttttttattattccctgctttagcgtttttctattccttttttatatacttccatttatcgctttctgctgccgtgcaacctgccgtggattgaatttttccgcaaaggtaatcgccagtcccagtcgtgtcaatgccggcattctgccgcgagtgaagtgcaaaaatcttcctctccgctggtgagcgtatttttcctcttcagccttgccagattgttcctgccacctttggatgcagaaaaaatcatcccggaggtcgcaaacaggccgaatagagggaaaataaaaaatattataaactaaggtaacggtaggactaaccacctgccacaaaaagaatttattatgttatacgttcacacaattggtcgcattggcaaggattgccaggttattactggaacacacggttcattcatcgcatttgatatggcggtagatgactattcacatggaaacagcgtcactacttgggtaagggtacggagtaagaaagagaaccacattcgactatccgaatacctgaccaaaggacggttactgctcattgagggaacactgtcggcttcacagtggaaggataaggatgaaaactgccagattcaactatccattacggcagacacattggagttcatcaataccggaaagcgggaggaagcaacttcagaagcaggtagtcagacggataccacaagcgatgtacctgtaccatcggtagctatgccacaagagaacaaggaagacttaccgttctgatgatgtgcatatagtgttgataaacaacatatactaaatgtagtagttactaattatagtaaagtagtgaattacctattagcgaaagtagtatttactacatttagtttgttagtattttagtatagtagtaaatactataatactaaaatactctttttagcaaaatagtatatactaattatagtatttactaagaatagtattatctttgtattgcatataaagacatcaagttatggcaaaaattatagctgttttgaatcacaagggtggggttggcaaaacgactaccaccatcaaccttgccgctgctttgcggcagaagaaaaagcgtgtactggctatcgacatggacggtcaggcaaatctcacagaatcatgtggtctctccattgaggaggagcagacggtgtatggggcaatgagaggtgaatatcccttaccggttatcgaattggagaacggacttgctgttgtgccgtcctgtctcgacctgtcggcggcagaatccgaactgataaacgagccgggacgtgagttgatactgaaaggtttgattgcaaagttgcttgacagtcggaagtttgactacatcctgattgattgtccgccctcactgggtttgctgacactcaacgcccttaccacagcggactttctgattattccggtacaggcacaattcctcgctatgcgcggaatggcgaagattacaagcgtgattgagattgttaaggaacgcctgaacccgaacctgagtattggcggcattgttattactcagttcgacaagcgcaagacactcaacaagagtgtagctgaaattatcaatgactctttctgtgacaaagtgttcaaaacgattgtgcgggacaatgtggcactggccgaagctcctataaagggaaagaatgtctttgaatacaataagaactgcaacggagccaaagattatatggctttggcacaagaggttttgaaattaaaataaggcaatatgggcaagagtgatttattgaaagacagcatgaaaagcggactggacggattgctgtcatccacgaagaaatctccgcaaaagaaggaaactacatcggttaagacagaaaaagagcctgctgtacattgcaattttgttattgacaagagtgttcatacgcgtatgaaattccttgctattgagaagaatatgtcattgagagatattgtaaatgaggcgatgaaggagtatttggaaaaaaacgagaagtgaggtatgttcctcgcttcccgttcttttaagtctgtggcctttgttagtatgttatactgatatgtgttgctacatatcattcattgacagccctttgtatgacagggtataacctttgaactctcccgttgcacgcatgaaagcggctgctttcgtttccagtttttccatgtcgatattttcggccttgcgtttgacttcgaaaaatgtcgctgtatcgtccagttcgttttcggctactatgtctatttcgttctcaccctttcggtcccaccagccaccaatacgcgtatagacttgccgttctatcagcacacgcttaaagtaacgttcaagcatcagaccgctgaaagtttcataatcccggcctataatcatcttcacactcccatagttctctatctccagcatatagctgtacttgtagatgaagcggaaccagaacgtgaagaaattgtcctcgatgatataccggacattcttggcggaatttttctcgaacaacggttgcttcttcgatatgatttcgtattctttctccagcttggtaagatagccgccgatttccttgcctaccacgttctcgatttccgaacgggatgtttttcctcgtgcaatggccgacagtatggaaaaatagattccgtaatccttgccgaactcttcgataagaatcgctttaccctctcccaaaaatatggagtcggcctttataatctggtcgagcatagccgttttagttgttgctcctgcatccacgagtagttgcacgtacttcgccacgccgcccgtgaaagcgtacaaggccagcagatcttccgccgtgtagccgggattgtattccgaaagaatatctttcagaacagtcggagtaaacggatgcacagtcataaagcgcgactgccggttatacaacggctctttcttatccttgaatatctttgtcatcatggaataaatcgaaccacagacaatcagattgatgtgtgacttcgggctgtataggtcccagatgcgctgcatatcgctgaacaccgatttgttcacacggaaaaactcctggaactcgtcgataaagagcgtgatgggacgttctgccgaaagtttcatcaggaactcgaacacatcggtgaagtgctcggcccgtcccatggtggggacacctaacttgtgctctatctcaagccggtagtcctcacacaaatcgccttcagctttccgggcaacaaagaaatagagaatcggttcgtcctcgtatgccttccacacgagtgatgtcttaccgatacggcgacgtcccgttaccactgtaaactgagcattgtcttgggccatttcgcgaatcttgcgaagagtggctatttcttctgttctgtcaaaaaatctcatattcttatcctttcttattgccgtttccgaaatggctgtttccgaaacggctgtttcgctactgcaaaagtaatgcaaatttccggtaaaacaggcaattgatacagatttatttagtaaaatggctcaaaggatttttgtctggtaagctccattcctgttttacaccgtctggtcttacgcccttccgcttgtcccgttgtatcatttatcatccctttgtagtcccatcggttttactatccgcctttcggcgtattcttccttttctatattcttttaatgccactcatccggtccattcctgccatcgccggttggttttccagacgcaaaggtggactgccgcgcttgattccgtcgctttgaagtgcatttcctataaaattcttcctttctgcgaaagagtaattttccggaaaaagcgtcggaaatcgcttattcgtcagtccttgtaaagcatctgtaaatcccaagcggttcaggcagaaaaaagaaccgaacaaagggaaaataaaaaatcaaatattaaaccaattaaatttttatgattatggaagcgacagcaattcaatcagcagagaaaaacatcacaatggtagcattggcaaatgtgcaaccgagtaattacaatccacgcaagaattttgacgaagcgagccttgtggaactttccgaaagcattcgtcagcagggtgtgttacagccaattggagtacgcccgatagaagacaaccgttttgagattgtttttggagaacgtcgataccgagcctccctaatggcaaaattggaagaaattccagctatcgttatggaaatttcagacgaggtagccgaagaaatggctgtcactgaaaacctccaacgtaaggatgtcaccccgattgaggaagccaatgcctaccaaaagctcatagatagtggtcgccatgatgtgcagtctttggcagtgcagttcggcaagaacgagaactatatccgtacacgccttaaatttgtttccctaattcccgaaatcgcacagcttttggagcaggacgaaatcacaatcagcgtagcgagcgaaatctgtcgttacggtgaagatgttcagaaagatgtgtacgacaaacacctcaaagaagatgcactgcatcatagttggcgagggatgaaagctaccgaagtcgcacggaacatcgaacggcaatataccaccgatttggagcggtacgcatttgacaagaccctctgtctgtcctgtccccacaatacaaataatatggtgctgttctgcgaaggtggttgtggaaattgcgccaatcgtacttgccttgcagaaatgaatgcggcatacctcacagagaaagccgtgcgccttatggaagaacgtcccgatgttcctctctgtcgtgaaaatactaactacaacgaaatcgtagtagaacgccttactgctatggggtacgaagtggaacgtcttaattgttatgcgaaagcatatcccaaacagcccgaagcacccttaaaagaggattacgatactgccgaagaatacggacaggcacagagcgagtacgagcaggagttgaacgattacacggagaaatgcgaggaaatccgtacccgatgtgaagcaggtgaaattaccctctatttccgtgttgagagcaaggatattgtactttgttatatgaccaaagttacctatgcctctaatagtacaaatcaagagcagacactttctccaatggagaaattggagaaacaagacaagcgtaacaaggaaattgttcttgaaaagactgtagaggacaccaaaaaacagattttggaagttgatatgtccgagtgcaagtttgggcaagacgaggataagatgatttatttcttcttgttatcatccctccgcaaggagcattttgaagcggtaggtatcggagaaaaaaagccttattgccaccttacggatgaagaaaagataaacatcatcgccaacctcacgagcaagcagaaagcgattatccgcagggattttctaattgctaatttcaagaacgcatacggcagcaatgccattgcatccctcttgcttgacttcgcacaaaaacatatgcccgacctgttggcagacatcaagaacggacataatgaagtgtatgagaagcgtcaccaacgtatcgaagagaaaaaagccgttcttttggtgcaggaacaagcaaagcaggaagcggagcaatctgacaaacagcaatccgaagtagggatgcagaccgaagaacagccacaagaggaagatattgcagcttaaccataatcactaactaacgaatagggggtagagtaatctgtcctctattcgttcctaattcaatgaaagtgaagatgttcacggacaactgctccaagctgttgtcgggcggcgcgtctgtcgggcaaacccgccatccgcgcgattatgccttttctattccatttatagctacctcccgatgccccgccgccacccgtctccatttatacctatcagtttcctcctttttatcttattccttatccggtccattcctgtcctcgccggttggttttccagacgcgaaggtggactgccgcgcttgattccatcgctttgaagtgcatttttataaaattcttcctttctgcgaaagagtaattttccaaaaaaagcgttggaagtagcttgttcgtcagtcctgtaaagcatctgtaaatcccaagcggttcagacagaatatagaaccgaacagagggaagaaaaataaatcattaaaatttcacgacaatggacaacatcaaagaaagcaaagagtacaaacttgccaaagaatgggaaatggcagtgaatagttttagtttcaatcccaagcgttttgcagccgctatacctgatatgcaccccacactgcaacagagcctctataggttgtttaaggagtgcatcattgtgatggcggacgagacacgtctctatgatgaccgcaatcgtgcatcacatgaagaagcaaagtgtcttatggaatacctcaagacaaacggaaagcatatcccattaaaataataaaataacaagcgtatgaaaacacaagaagtacaatttggcggcaataactatccttgccgtgtggtggaatccaacgagggtgaagaactccttatcggctcgactaccttgctcgatgcccttcagcccggtagtttcaacgatgaaaatgaaggcttcgcaagcaaggaagccgaaagaatctataacgaggttttcttctttaccgatatggcaaacttacgacttacagacgtagaactggttgccgaactgaaaaaggacaacccggaatggttcgaataaaaaaaacaataatcatcttaaaaatagcacagttatggaaaaagagtatgtaatgcaaatagcacagaccattaaagagcagttaataggacttacccctatgcccgtcctcatgtcatggggtatctcagagtttgcagccaccatcttcaaagagctgcctgcacttcgtatcaaagtaaacggactgttacacgccggatacgttattattgcacttaatgggtcagattattatgagatatatctgttgaaagacaaagatgtagagtgtgtcaatgaagaagtttgtttcaacgagttaggggatgtcattgacagggcaattgaatgcggtactgacaaagaggaatacgaaaaaatttgccatcagcaactcaccaaattattaagcgggcagttctcctgataaaccggaagaagattagtagtaaaccgtcagtacgattgtactggcggtttttgttcttcttatatcagacagccggatttttatttcgcgttacgcttgttctgaacgtcctttatcatctctttcacatcttgtcctacttgtacaaagtttttgtataggatgcgttcccgttcctctctcgacttgaaggtgtagaacttcggcagcggcacatacgccgcttcctctttcttgattgctgccatatcaaaatctgttttacagaagaactttgtagtcttgaactcttccgattcttgaatattcattgaaccgcccatacctgttttcgtcttcacaaaatcccgtgccgtctgaccgcatatccatccggttgccatatccgagattttcgaggcaggcacaaggttatccatattttcattgagattgatacttgttttgtcccggtcaatggtcacgccttttttgacctgtaccaccttgccgaagatgtcattggacaaccattccagcgtttctttggcacgtgccgagccgcttaccacattgcctaccgtcgtaatgattttttgcatacctaccttaccataatcggcttccagttgcggtagttcctgaaagccgagcgttacactcaccttattgcttcgcgccgtacctatcagacggtctattttgtgaaagtagagtgtcggtaactcgtccactataatactcacgggaatatttttcccctgcccggtattcacacgggtaacgaggcggtttaggataagagcgttcaatgcgccgatgatggactccatttccgggtcatttgcaatcagcaggtaactcggattcttcgggtcactcaccttcaggtcgaagtcatcgccatcccggtggaatatccagtagctctctttggttgccagacgcgaggtataaacacgtaacgtgccaatcataccctccagttgctccattgccttatttttgaaagctgtctggaacgggccaagtagcggagcaacctcattgtcagtttccagtacctcgaaaatcgtctgataactttcattcaagaatgacagaatatgtggcatgtccgaatactttcccagccagtaggcaggttccacgatattgccgccttcacggtcacgcacgatacctgtcggtttccagaatttggtctgcggatcttgctgtctttccgcatatagaggcttgccgttggcatcgtagggttcacgctcataattcacgaaaaagtatatacaggcggcaaggaagtttaccgccgaggtttggaagaactggtcgcttccgccgccgccctctttcttacccttttgtaggctttccaataatgtttccgccgtttcgctggccgccgcgaggttgttgatgtactttgcctgaattggattcacccgacggctgtactccacatccacaaaattaatcatgttgaacttacaccctttgggtactctgcccagtttctcgttcctcttgtaatggtagtagagcttggtcgccaatgtcggaaacttgtagtcatacaccaccatggcgaaacctttggccgaatgctgtcggataaacggctctatgatactgaaagtcttgcccgaccccggtgttccaactacccatgttcctctgaagcagttacttacagaaatccatcccttgcggaatttacccttatagtagtaccgcatggggatatttacgctgtattcattctcgactttttcctcacattgttcaaaactttcattctcgaagttgaaacggtctttcatcagtccctccttgatgaacttcgaaatgttgtctaatgcaatatgtaccagtactacgccagcaatggaggcaatcatatagagaatgatattcaaaggtaaggtataaagccttgttcccatcgtatggccgaacatccatacggagattacgagcagcaacaacccgctcgtcaatggatacaccacctgccggcgtgcgttgaactccagatgcttcttgttccgcgttccgacacaagtgatgcagataagcagtaccgtcgcaattttgctgtacacaagattgccgtcgtggtaaatcatccattgtttgatgcgtccgtgaatgtcggtcagtatgccgccccagtggtcgagcattgcagggtcaatggcatattcaaagaactccagtagtacggacacatataccactgtgcggaatatcttatagaacccttgcaattccttactttcttccataagtcagtctgttattaatccctgttttatacgataccaatgattgcctactctgattacatccataccgaaccatgcaccattctcattcagttttgtttttatcttttcgagtgttaccggaccgacaccccatatttccatgagatattgctcgttaagatgaatcaggtctccgatatataatattccatgagattcaagatggcttttgatggatggggtaatacccaaactgaataccggttccgagagatagtgtacttcttctgcttgaatgttattcaaggctatttcaagtcccactttgattcttttgagagaatcaaggcgttcttgtatcttttggatggcaagctcgtcttgctgtatctcattgcgtaactgggttgctctctttacaagttcggcattacttcttttcaattcttcattaatatccgccattgacagattgcttatttcaagttcgtttcgtgtgtggtccaattgcgtgacaagttcctccagtctgtcggcatgacacttcagtattgaatttttttcattatcggcagccatttcgtccaaaaggtagccgaaccttttaatttgaaaattaatattttctttatccgatgctatggaatctgcgagttttgccagtctttgccggcatgaattacctttcatggacttatacatgaggacaattcccaatatcatcaacgctatgctgaaaagtatatccgtatctttcatatctttctatcctttattcgtttatggtaattatagggcgtactctgtgcgcctgtactttaggtgtttcttgcattgcgccgctccccatggaatagagccatgccttggctgtctgttgcttttcgacctctgtggatgtccagtaccaacagtcgttttcatccagcggtaacggctcgccgccacattgttcgatgacagggttgactatctctctcatggtgtagagcagccgcatctctgccacggacggtacataggcactttgtccgtaccgccataggtcgaaaaccgcttctgccattggcgaagccgtttctcgtgtatcgtacagtgcgaatgtattctcgttgccatcataagccatgatgtcggacgatgtgccttgtgcgatgccgaggctgtcggcgaatgcctgtggagcaatgtcccacaggtaaactgcataaccgcccccctccgtatctccgcgttttccggtatcgaagacaaccgctatcgcttttttccccgattgttcatattgtgcataaggcaaggccgttccgtcctcgcagaggatatgtcctggacggaccgctgtatcgggtacgtctatgtgcgtgtcacaggcagcgcacagcacggcagccgttgccgctgccaccaaatgtatctttcgtatcatattgctttctttttttgtttccctatttcataggtagtttcacacccagcacgacacctgcacgcagcacgtccgcaccttttatcatcacatcgcttttcacttgccaatacagtgtccatccggcccgtagcacatagttgtgttcataaccgaggtgcaggccgccgaggaatttattcgtgtcgcttccggctgaagctccgatacgcagactgccatagtggttgcgtccccgcgtcatgcacggcttgtaggccacgccaaaaccgtagctgcggtagtttcgccaaaatgattccggacagatatgaccgcacgagccgcactctgcccattgtaggtagccgttgacgaaaaactcccacgcatggcggtagttcatttcatgttcgtaggcgagcgttatatccatgccgttcttgtagagtagccctgtgtcaagtgagaggcgtccgctaccttgttgtgcattcgcacttgcagcgacacacacgcaggtaattatcaggatgattgtctttttcatagtcattcctcctccaataaatctgcatggaacgaatctgccgccagtatatcctcatagtcgatgttcaggctgatgttacggccactaatctgtttctccgtcatttcgatggtcagcagcttgtcattgggaaaggtcatctttttcacgacaatcacattccgatagccgtgtctgaacgtcttgcccggttccagaaccaaggcaggtgtcagttcaatagtctgtgcgttggttgccttggcgagtttcttgtctgtcagttttatccgtatctcatcaatgtcaaaacggatgttcgtcttgttctcgatggaaaagtctatgaagaagtagttacccaccgagtagatattgttcagacgcatcaccatacggtgtgctttggtagctacgttgcggattttcgcaggtgagttccagatgcgccgtgcatgatgtgtcatgtcggcagtggacattgagactgccggattgttatacgcattacgctcttgcagcagtatctccttatccgttactgcctctttcatccttgtggtataaatcagtgcgtattgtgtgcggtaccgttccgttacaatggtgacgatggcgagtatttcaccatcctcgtgtccgctttccttgggctttaggcggatgatgttgtcaatgggctgatcacccgccaccttgtcagtggaaatatccacgaaacgcaccggttccgatgccgttatgacggttgttatctgttcgttcaccgtcagttgttccatttcctcataggtcgtttgcgcctgtgcgttccgcgccagcggcagccctgccgccagaagaaatgacattgcgattttcttccaattcatatccatgttgttaattatatttattccgtttatttcctcttttcccttatttctcctctttctttacctgtttggcacgtacccatgtacaacgccccgtccgggtcatttggagttcacactgccaaagagtgcctttctccactgttttgaaattcacatttccgtatcttggtccgtaaaaaccggtatgtttttgaaaagcgaataaggcaatcctccgtctgtcttctgtccggaagttgcatattagggcaaactgccctctgtgatgccaccactcggcactcacaagttttccgataaatgtctcggctttattgggggctatatagtccgcataataaagcccatccgtacctttgtgatattctgataaatctgtttccatgtcatcatcgttttatttccttttttcctgtccgttcaccaaatacacgaaagttccgtatttcagcttgactttgtttttcttgatagctttgctaatggcattgcttgttttctggtaggcattgttcaccgcctgcattccccattgtgcaaggctgtttcctgtacttcccatactcatgttcatattgcccgacattgccccgcttgctacatccttgctcgtttcccggaattggctgttgggtacatacagcccttccatgccatcagtatcatagagtgacagactcactttcaccagttcgtcattcacgaggatgctgctgatattacctttcacgcgtccggatgagaatccgctcactgtagcgtacaggtacgttccccttgctaccacacactcgccaatctccacatcgtcaagcaggcgcaacctcacgcgcgagccgtccaccgctttgatgttctcgtcaatgatggcttggataagtttcggttcacggacattcttcgacagtgtgttaaagtagtccgaggttgtcttcaccttgcgtaccacttcgctgggcggttcgtccgcagatggcgttttcacagcccggctctcttcgttgatggttccggaggctgttgctccttgtggtggagcaatgttggccgtgtccgtttctgccgggggtacagtcgcgttttgccctctcagtctcgcctctgcgagtgctttttccagttcggcaagtgcttcttgttctcgtgtcttggcagaggcaatttccgctgccgcagctttttcctgttgttcttccgtgagcaggtcgatgtcgtcctgcgtgtatttcgattcatactcttccttgtttttatcgggttcttcccggtctatgttatctactgcggagtagtcctgtatcttaccccatgatttcgccatattctcgtatttgctgcctatgccatcgtccttgatctgtgcccccggcaattcggggttcaggaactccgtcgtctgcaatgccttgtcttgtatttctatcgtttctgtctgaaacaggtcgaagatgaaataagacgcgccgagcagggggaaataaaggatggcgggaagcatatatttcggctggcgaaaattgattttctccaatatcttcattatacatcttttaattgagttgtacatacttgccttcaatggcacaatttctcagtatctctgcgttgtcttctccgaaagctaacaggaggctaccgcaaccgggagagtcacctcgcgttccgtctggtcggtagaatcggatgcggtggcgtaggaatttcattcccgttgcttttgggaagatgacgtcctgaaacattttggaatcacaacggttgaataataatgcaatgccgttgccatgttctgccagtttccggacgaatagctcgataagaggacgcgaatagggaggattgagccacacacgtccttcccatatctgggacaacccgtctatgttctgatcatacatgacctcggcagtcggccacaacggacggataggagcgcaagggtcaaggtcgaatttgcccaatgcgtccagtatctcctttggcgtgtaccattcgtctgacgaacggactgatttttcaaaccgtgtattcataagcattcttttactgtggtttgtcccctctgtttttatgttcccttatttcgacttcctgtaacagcttgtgccgttcccgaagtacagaatcctgcatttccgttgccgtgcgacttgtcgggctgtgcctgtacacagttaccaagcggtaggcgttccatgcgaaagctccgatgacgaatgtaaagacgatgaccagaaacagcgtccggtgcgcgttggcaaagccctgcgccttggccgccgcttggtcgatacgtgtcgccttggcgaatttgtgcccggcctgcacctctcgctcgtagcgttccttgtactgcgggtcatctttgtccggcatcttctcgccgaacaacatccgtttgaatcctttgatattcatatctttggtgatttaatagttactctttgttttttgctcgatatctttgttcagcaatgtgcgccagtttactatgagcagtccatgcggattgttgtccgttctcggcacacgtttaagttgccctgccgtaaccagttcgcgcatcaggatattactccgacgttcgattcgctgccgaccatagtaggtgaactccatattctttttgtcaaaggagatactgtcacagaaaatcgagaacaccgcgctcgtacccaatatgttggagtaaaatcccttttccttgagggtattgtattgtgccagtcccgtctcatcgaccaggtacatcgctttttccatcgtatagcggatgtatttgtcgtccggtgcgagagtaaaaaagtaatggtggaacatttctacatggctcttggcttccacgtccagcgtttcgtccatcgtcgtgcgggttacgagtataggtacatttccgtccagcacatacacctttttctgtgcgtccgtcaccattgtccgggcagtccagatacttgacacactgatgatgatacaccctacaagaaaagcagtgcagatgatgcccaccagtcggattttattctccaaatgcttgatgaccatatacctttattttttcttgttagacaatcgtgtgtattcgtcatgtaacattgtcatgactgtatcctgtaactccgtcagaaatttttcgaacttcccgtcaaagagctgtgtgtaatcttcccgcatgattacatgcacgaatatccaccagatacggcggtttcgattcttggcatttttctgcaatttgaccagttgcagacgataggtaaggtaagtcatcatagggacgatatatcggttgtcccatgtaacggcttcgtccagttcttcatattccggatcaattcggtggttaggtgcataaacgagttcttcgcttatgcgttcatttgcatagcgcacgaaacgctcgttcctgcaccatttttcaattttctgttgtacattcatcttttggatatttaatattaggtttatcattatctcatcatcgagccgataccgcccgtagccgtcattttggcctgctgcgccacaccttctccaaagttccgtgtagagaaggccgtgtcaccttcaggtatcatccatgctgccaagtccggtacgaggtttaggcatttcagtgccacgatacttgccgccatcaagtagccggcggagaagaagctgttttgcaagtaggccgccatcgtctgttcgcttgctgtgattgccgtcaggttttctatctgtatgcacaatacaatgtcgaatagcagtagcacatagaagccgacgaagtagagcatcgcaccatagaaatgtactgtcagataccttataagccacttcgcccatgcaccttcccatttgggcaacagcgagaacgcccattgtataggtccgaatattgttaacatgcccagtaggatttgctggcagtagatggtcgcccaccatccgatacgatacacaatcagagcgataagcatgatgattttatcgatacctacgatgactcctgccgtcagtgaggtaaaccacagttcggctgcgtctttctccattttcgtcacttcgtccactccggtttgttccatggtcgcttctaccagattcgggtctgaggtacccgtgtgagcgacatctgcctgtgcttgcaaactttggtacatcgtgtcacgtacatggataagttgctgcacttcctcgaatttgtccgctatttgggtggcttctgcctcgtacaggtcatgcgtgtacgagccgatgcagttcgggatgtaagacaggaagtcaagaaaacaccaactgctcccactgccagccatacccgtgtctgctggcggataccaccaacagaggatgattgaaacagccaaaggacggaacagcttcagtacatccagtggctcatgtttcaccatcatcttgtacgccattcccgctgccatcacaatagcgaacagggcagccagtgccatgcacatttgtagtatccaccagaacggtccctgcgagccggtaaaagtcgcatcagtcaggaactcgttcgtttgaaaaatcacatcgtctatctcttcttcaaggatattgataccgaaatccgagagtatatttccgtctgccatacgtttttgttttttcagttccctttgcttactgtttcatctccgtcaccgctgtcgcccgtgttattgcccgattgcgggccgcgcacggcaaagcgcgattcgtgccaccggctcaccgcatcgcggacaatactcttcttatccagagtacggtcagcggtagcgttcagtagcgtacttgttaccgtagtattctgccgtttggcaaggtagccgacaaggatttcgttctgtcgggttatatcctcgtagatgcgcagatactcttttttccgctgtgcgttgggcatataggcatctttcgttgcatcaatggcgcactggtagatatggtaatattccgtccatctgtctttatcctccggtgtccccccgacaggcaagatgcggtctatatttcgtttgaaccgtaccatctgtccgttgaccttatcgccttcggcgagccatgcgatgtccgcttgacggtcagccacgttcaaggcctctatctttgcccggctcaccaatgccgagtcgatggcttcagcttcatccgtttggttgtacaggttgacgcccgccagtgtgcggaacgacagtttgttcttggctgctgccgactttttgtacttgttgtgcagtatggaatagtagaggtcgggcgagagtgctcccgtaccggtttccattactgttacttgattttgtttcggcgaatcgtggttataggtcacggattgtgcctttgccgccgtggttgcaattattgtaaccgtcacgagtaagagtattctgtccatatttactttcggttattttgttactaatctttcaatactcaatgtgcttcaatcagttaatcaccgagattattccacatttctttttatattatattcatttctaatcctttcctctccccgcgagaagtgcatgtcatccttttcaatacaaatacattttctattcgtatgaatacaggcgattgcagtgctcatgcttccagaggcaaaatcaaggactgtgtcaccctctttcgtgtatgttcttatcagatatttcaataatgcgactggcttttgattaacatgaatcgttttgccctctgattccgcagttttgaaatatttcacacttcgtgggtatctcgttcctttgttttcatttctgaatgtaggatttggtaccttgtttactcctgtccagttactccctctctttgtacgattttcataaggctcaccttcttccatgattggataataaggagttctgccgttacaaaagatactgattagctcatgcgcttttagaggttgctttttagcaagaaggaaattgcttgcttttgacttttcccatacccagtcatatttaaattcggctaaattgccacagcgtaaaaggctgctgaacggttcgctgccaaataaagccgtaggtgcattatcctttctcacccttctaatctcctcccacattttcgagaatggtattatcttatcccattgcgaagctgtaattccaaaaggtgggtcgcatagaactaaatcaatacttgattctgggagaagaggcattacttcaaggcaatcggctttatatagcgtaatgtcttttgcaaaaacgatctttttcattacatcttttattaatccaaatgtccatttgcctcttggttataggccggatagacttgtttgtacttaaagtttctttctctgtttgtacttctccgaacatccaggacgaaacgcttttcctgcgttttaagatattccttagcaatttcggtgcatagaagtcataatctaacttgtggcattatttacctccttcctcttttaccgtcaataatccagtcgtcccgcattgcgccaccgtccgaaagcaccgtcaataatttcccgtttggtacgttcccggtaaatcttcgatttccagtagccgatacgtacctgtatgtatctccatgtctcgatgtatgcccggttcaagtgttgctcaatactgtccagcgacttgttcacggactccagtaccatcagcaggtcgctggtcgagcaggccgctgcgcccgtggcatacagcacgaggtcgctcaccgacttatagaggtgttctccctcgttggcgatgtcccgtattgccttttcattgatagtcagtatcagtgcgtctgacggctcgatgttcccatgtttcaggattttctcatggaaagcctccagcatggtcttatagtcaccgatacggtcacttaccgaactgtaggtatccttcacgttcagcaccgtccgtagggactggtacatcacgtcgatgacatcaaaggcacgggtatagcggtcaaggtcgatattcacttccttgtatttgcccgtctcctcacggctgtactcgtgcagcagttggttgctgtattccagtgtgcttcgggccaataacaggctgcgttgtttcttgtggtcgttgatgtacgcttccaccgacatgatatcgaatgtccattgacccttggctacattgggtagtagcgcaagcaacgtgatggctatcagcatagtgcgtttcatggtcgtacctcctttctgccacttcgggatgtccgtgcgttttctacccagcggtcatggcactcttccacgagcgtcagcctacgaccctcgtccgtatcgagttccggtagcacatccttcagtacgtcgatgatgttccgcttgtagtgcatcatcttctccaaggatacgaggtcggcgtatattttcgtgatacgtgaatccacttctcgtgcgatttcgaggcggtcacttgaccaaagcaggtggtacacgtcgctgttcggtacttcttccataggttctgtacgggcatactcggtagtgattttacagttgggatattcccgtgcaatttccgatatgcgattattcacgattttagtcttttcctcgttcggcaggttcggatcgagtgtcagtacatcggcaacgtgcgtgtctgtgtatgccgaagtcaattcccaactgatttggatgatggcacggtggattttgatacccagaaagtatttcggcttccgtgcgatagaaatagtcgcacggaacgtaatgataccattgatgttcggcatcgtcgccttacggacgaacgtatagccgctccatgtacctccgtcctgccaagtgaggctgtaggctgtcttacaatcctgcatgatggccggtaggcggtagtaatcatctgtcggcacatcgttctcagcttccgcttcctgcttcgcatctgcgtactccttctgcttttgttgccactcggcaagttcgcttttcagttcctcgatacgtgtccggttggagttatattgttgccggtaagctgctgcgtcttccacgctcgcctcggcaatttttttcagaaggtcggcgttttccttttccaaggcactaatctgagattgaagaacggcaacctgattgtccgcttcccgtatcagtgcgtccagttctgaaaggtccagttcgttctccgttaccgaggtctgcatgacgcactctttggagtgggcatccagtgagccgccacacttacggcacttgtattgtgtcgagccttgtcccagcgtcgccccgtctgaacaggttacactgatggtcacgctttcacatccctgcaattttgcggcgtccgtcgcctgataatagttccgtgcatcggatgctatgtaatagacatagccttcctcgttgtcattgaactccgagaggcgggcattgagctgcgctttgaacgtgttcagatccatcgaataggaatcgaagacatcctcatagactacctccgtccggttccagctctgtgtcacatgtatctcataggcgtatgccttcttggtctgcttgttgcctttgctgatgatgtaggcctgttgtcgggtattgatagtataggtgtaaccgtcgttgctgttgttgagctgttgtactcggcttcttgaccatccggcatactgttctgagttggcaagggcctgctcccgttgcgaagcgttcgggtaaaatcccggatcgctcgtattaaagcgtgtccatgcgcccccgttcaatatgctgttgtcgtctgtcggtgggtagtagtcgcatagagaaatgcttccttgctcacgccgtgcgatataccaccgttgcgtgtaatagttcccgactgcattgtccatgtagtcggtcatccacgatgtgaggtcgtagttgctgaaattgaacaatgcggccacgctgtcctggccgcccaccatgtcgattagcagactaccgatgtcatgttccgcctgctcgaagagagtaccgtagtgttcatacaggttgccgatttcattggctttgccgcccaacaggtcatggaacgcactgctttgcagtagagcgtcaccgaggttctccataccagatgttgccagccctacgcccatgttataaaggttgtcgatatcgcctttcaagttctcgatggtgaaattgcccggcactttggccaagttgtccaacatccgttgccaatcggtaccgcccagttctgcgaggttcagcaaactggcgatgtcgcggtcaatttccagaaaagcgatgtccgagaacgtcagtgtgctgttggtcacaacgctttcgaactgcatacacaggctcttcgtatcatcgcagactttcatcaggtaactgccccagtggatggctgtttgtggtgagcgtagcatcagtttcgctaccacccatattttcggcatgattttctccgccaccatatggtaaattcgacgatagtagtaattttccgtgctgctgcaccagatgccaaggtcggacagagccttgtgttccaaaaatttggaagaaaatatccctgctgctgccacctctgccgccgtatagtgtttcagaatatcatccacctgctcgcggtagtagctttcagccactacctccgtgccgaatgcggcggccatggccgccacggtacgtgcgtcatagttcacgctgtaatattgtgcgtgaacgtgctgtgtcagggcaggcaataggataacccaaaagataaacagccgtttcatcgtttcagacctcttttatgtattccggttccttgtgattgaaataccaccgctcagattcgatacaattctccgtgacaagtcggcagaacatatcatgtatgatggtagtatccttgatggcccttttgatccgggcttcttgggagccgaaccatctcaagaagaaaggctggtttagataagtttcgcgcacggtctgatagcgtagccatcctaagtcactcagtcttttttcactcatcggactgctgttcagttcccggaatagttcttcacgaaatccgttttcatcgaaggcaggtttgctgctacacagcctgtcgcacatatcgtaaaactccttttctttggggttttcttcataatatcggttcaagtacgtttccagttctacatcggacatacccaaccgaagggaatactccgccaatagccgttcgatggcagctaccttgtccggtgtcatgtcatccatacggagcaggttctccttggatagcatacaaaactcccggagggacaaaacagtgagttccggattattgacagaaatttgttcgcgcgtcaagctgctttcaaaccccatcatatttattccgtagtccagtgacagggtgattaaaatccttttcgttttcattatgatgttattttagtggttaagttcagtacacgtcccgcttcattaactttctgtgcaaacggcaatgccttgccgataccgctggcatcccagtcacggcaatatgcctcgatagccttttggtggctgcattgtagctcgcgcttgtaaagtttcagagcctctttctctgcccgttcagtcgtgtaggtcatgtagcactcgtgcggttcctccacgccataaacaccgctggtcgtgccccggcggataaatacctcgcggaagaagctgcgtccttccttgttttcgaggcggttgatggtgaaaattttcttacagtccacgtccgttaggccaagaatcgccttgatggtatcgaaacgttccttgaatttgctttggtcaagcagcatcaccacatccgagttgttgatgatggcctctttcacgatttcgctgccgatgatgtcctgtatctcctgtgtcaccacacctacactggcccagaatttacgtgccgttttgtacataaatttgatgtattccgccatcagcgggctggcgatggctttccacgcttcctcgatgacaaggactttgcggttctttttgatgcgcattttctgtaagaaaacatccatgataatcagcgtgaccaaaggaaaaagcagcgggtcatcttttatactgtcgatttcgaagaccacgaacgtctcgtcgaacagcgagctgtccatgttttcgttcagcgttttttcgtggttgccgcccaaataaaagtccttcatcatatagcggtatgtcgagaggtcgatgcccgtgatacggttctcctcacagatatccgggatgcgctgcacggaatattcatagaaagagttgaatgacagttcctccactttcagttccttgcgccgaccctctatctcgtcaatgataccctcgatgcgggccgcacgttcccgttcgctttcgtgccgcttctcactgctgttgcggtcatcaataacgaggctcttacgcaagtcctcacgctgttggggtgtgaagctctcgaaaccgttgaagtaggcgtcgtaatattccgtgatgacgtgctctatcagacggtcttccgtctttgtgaccgttccctgcgtacctttccagataagcaagacgaggtttttcaggaatcccgttttttctacgttcatctcttcccgattgatgcggaacggattcatcgtgatgggccgttcctcggtatagctaatatacttgccgccgaaatactcgcatagcccctcgtatgagttacccgtatcgaccattaccacgtccgtcccctgttcatgcaactggcgcacgacggaattcatgtggaaactctttccgctgcccgaaggccccaggcagaaaaaattcgagttgtcggtcagcttgttctttccctcttttcccgtgatgtcgatagctaccggaacaccttgacggtcagtgtaataaacttttagcggtgtttcctcactatgctgcacccgttccttgtacatcaggcataccgcagcgtcggagagggtcagaaaacggtcatattcctcgttcaggctgtaacagttgcccggaaacgaactgacgaacagttccagttggttgtatgcacgcttactgatgtgtatgcccatgcgcccaaaagcgttttccaagtgattcgtgcatttttgcaggtcggtgtccgcaggcacgcccaccaccatgttgaagtgcgtgtacacgagcagtttgctttcacgggctattacgtcctgtacctgtttgatgtcctctacggccatttggttactcggattggggatgcttgcgtgccggttcttctttttgtcgagtaatgccagttcccgcttctggctgggcaggaaaataatttggttgtacaccaccgtttctgcgttcggaatattatccaccaccgagacaagatccactggcatctcggtattattcacctcgatattggtatagggacgtatcagcgaggggagcgcggcgcagtccacgtccacgaggctgtacaccttacagcgtttgtcacccatagataccgtttcgtcgtcagccttgacattcgtcatcgagaccatacggtctttgaagttcatcgcaaagtaacggtccacatattcgcttgcctcggctttgttcaggaatttcacttgtacaccgctgtcgcgtagtaggtctcgaaccttataaattttcacgaggaaatcgcgccatttcttgctatcgtaagagaaaagacggctcttcttggcttcctgtgtgatagtcagatagcaaaggctgtccgtgtacggacgcccattaaaataacggaagtacgatgccgagagaaattcttgattatgctccggctcgttcgcgaactgtttccttacgaagatgtcttgtttgtgcaaggcatacccttcgcccagcgtctgcgcaagggcagagaatagatgcgtgaagtcgtaatagctgtcaatgtccgctgaatacttctgtaccggattttcgattttcaagacggcggaatattcgcccgtcttggtgtacagcacacccacaccgtctgtatcttccacagagaaatagatattctgaaagatatgcttgcgcttgccgcccgtaccgaacgtatagactgacaaggccatacccgtacatagggcgatgaaaaataaaatgatatatagggtcattccgatattcgttcattaaataggggcaggtctgcctcggctggagacggacccgcccgcgttcaacaatcaatcagccacacacattgccgtgatggtttttcttatagtcatactttatgcgaataggcatacacatacactccacgttttacatttttactgtgcagcccctttcgctgtttgaggatgataagcacgattcccgcagataagacagttgccaatacgaccagtccggccacaaagcccataagacagtaggcggcgatgaagcccacaatggccccaccagccacgcctgccgcccaatagatgtagcgaccttgtaatcccatcagttccaaaggccgttgcagtcctttgaacagcgggtaatccggataacgtccgttattagtcattcctccaggctgtttatgcgttaattccgaagaatagaggtaatgcttgggctgccgcaatcaggaaaaggcacgccccaaccaccatcataatcttcttcttgacatcctgttcctcgttgttcatggcgatatacaccgaaatggctccgatgatggccacaacaccagcaatggcatagcagagtttgaccatcacaggaacgtatttcacgatttcctcggctacggttgatagagctgtcgtaccggctgagtaatcgcctgccgtactttgagccatagcaggtatgcctcctaacagggcaatgattaacatttttactttggtggaaacttgcatgatggttttctttgcctttcggcacattcttttgaatttctgaaacatatttattacattttttgtggtacttctatttttgaattggttttacactcctgtcagccacctatatgcggtagccgaagaaagcggggaacacgattgaagctccaatgatgaagaggcacgcaccgacaagtgatacgatagacttcaccacaccgtcctcgcctgtgttcattttgatatagatttggagcgcggcaacgactacgaaaaccgaggcgacagcgtagcagatgtacagcacgtacagcatcatcgtcaccacgaagtcgtgcatcgttgcaagtgcgtctgcaccccaactgtagtttacgctgccgcttttggcgaataccgcataagggacaaagcacagtgcacataatattttttttgctttcgacattttacaatcggtctttgagaggtttccataccagttccggacggttgtccgtctttcctttggcaagcatcgctttgtacagttcgtctgccgtgtatgcgtccgacaggtaggtctcggtttcttccatctgttcctccgcttgggctttcagccgtttcagcttctccgccacggctatctcgccattattctctgcggtttccgtctcctgtggtgtaggtgaagcggtaggggcaacatctgtttcatacttctcattacccacattgaatcccgtatcgctctccgtcacggacacactctgttcatcttccggcgcaccgaggtcaaatacctcttcttccggcttaccatttcctttttttccataaaggtcctgcacgatgataaccgcataatagacgagataggcaactgtcaggacaatggtgaaaataaaatatgatttcatatctttttatgtaatatgatttattatatttgattgtggctgcaaaataagaatggataagtttaaagataaaattattggctacaaaacatattattttaatatgatattttctcaaaatacaaaaatcatattacaaaatcatattcaaatacgattttacataagaaagcaggaaaagttggggtataaaaaaagccctccgtgaaggagagcttagggagtgggttgttcattgtttcttcccgcgtaggtagtcgtttaggtctttgtaaccggcataacggttggactcgttatagacgcgtccatcatacatcccggctatggtttccactgtcttttgtccggcaaggtcattgtcaaggtaacagtggatatacgtgtatttttgcagatacgtcaatgtctttttcagattactgatcgagttcataataaggtggtcacagggagcattaatacaaatggcactatcgtccgtctgtttgagagtcagataggacagaaagtccatgaacccttcaaacaggcagacacggctctgtgtctcaccacgcgattggagtatcaaagaaatgtccttgttcttgatacatcctttataataagggtttcgcacctcgtatccaccggagatgttgccaaaagccagtgcaaagtaacgtcgctggcgcagttcgtaatgcacttccttacagaacattcgtccgatatccgaatcaatcatacgtgaatggagatatgagaacagtgcgtggtgtcgcagcggcacgataatcagatttttcatgtcggcttccacgggtcggaacgttgtgggcaatgtccgggttttcggtagcgatacaccattgacatgccgttcgatgtatgctaatgcttcactcacactttttgtttcgcaaaggtacttacccagttccacaaggtcgcctccggtggcctcgccaaaatcataccattcattcagccggtcattgactttgaacgatggcgtcacctctttcctgagaggcgaaagataccagtattgctctgatttcatatactgcgcacggtggccgagctgggccaaaaagtccacgatacgcactcgttttgcttcatctatggtcatattcaaattcttttcacttgtttgcgcaaaagcggtttagtttagtttgcgaccctatatatataaatactaaattaaactgaattatataggcccgcgcccgctctcattcttcatcgaaaagcatggtttctgcctgtgtcatgtcataataaaaaagtttatctcgtttgataaccagttttaaggtgtcagtcagatattgcagcagtttgaccattacgtttctcccacgcttaaatccgattgcctcgtaagctgtcatcatggcttgcagcatattttcaaacccacggataggtttgtctccaaacgcagcggaaagggcttcacggtgctgttcgacgcttagttccataaaacccgtccgctgtttcggtttctgatgtggggcattctcaaacaaatgcccttctgcgagaaccgggagcccgccctcattaacagtgaaagcaaagggtttaaactctttctcacggatgtgtaacgcatgaacctcgctgacgttgggacaatcgttgtttttgctgatgaccagtacagtctccgccttgttgctcatttccgtaccgatatgcccgcgcacattgttatctcctttattcaagtgtagcacacagtggatatgcaggtcatactttgatgaccactccatcatcttgttaatgacttccacggactcaccggtgctgtttatgtcaagcatcaggtcacggataccgtcgatgataacaagtccgtatccttttctttgacgtaaggcgtagtcgatgaccccaatgcgtattgccggagagtattcgcgcaagcaaataaagtcgaggttttcactgtcggttgtagtgggcagtccggcaagccgcaagatgcgttccagtacattatgacaatgaaagcggctctgttccgtgtccacgtacagaatcttacgtttaccttccgggaggtgcgcccggtagttcagcacttgttttcctgccagcgatgcagcgacaatggccgaaacgttaaatgttttttttgatttcgccttgccggttgatgcgctgaagttgccgagcgtagcaatggtcgagttgtctatccagataatctgtggcggcgtttcataggtgtccgtcgcccgaatctgcgaggcggagaggatatccgataagaaatcctcctccggcctcatatccacattatagtcagttcttctttcgttttccatggcgtctttgattaaagaaaggttgtgtggcagcggcctcgtttgccatacgtgctgcttcatctacggttggttcataattctgcaaaagccattcatccagatcttctttggcgaaatatatcattttgccacgtggcttgtaatgcggaatctccttgcctgatgttagcttgtacagcatactctcggatattccgatatacatacaagcctcttggaaggtaaacacctgtttggtggtatatatatttttttccagcaatgcgatgcgttccaacagactctctatcggatctaatttctttaggatggcttcgacgcttgtaagccgttcactcagccgttccatgaatgtcaatctattattttgcataaatgagttattataaaattagacaatggaagtatgccctccgttatgtagcgcgctaacggagggcaaagatagggcaacccaaaaggtcagcatgagtttgcaccgtgatagtaaccacgtatcacggcaactatcacgcttttacctttcacatacttcgcttattggcacttcttaccactctctcagttcatcaatggctcgcctgataccgtaacctgctgatgtcatgttgttgcgtagagcagacagagcggatgaaaggcttgaagctgaaacgaatccttttccgtccttggtttgtaagaaccgtccattactgagaacggtctgccatttggcttggatgaacgagtgttcaaggagtgtatcgaacaggatggccacatgacggatattgtttacacgaatacagaatccttccttgcaggaaagcagggcttccatatcttccacgtgtagggtagaaacgcaaaacagatgataagcattggcacaagccgtaatacctatcatctgtttacgagtgagattgcatccaaaagaaagaggataaatccttgtcgggccgtctttgcagcacgtgatggactgtgatggtggcacaaacatatcatacattcgtttcagttccatacacttctcgaacgagaagtctgcttcggtaaaaagtgatcggataagattggaacaatcgtttaataatcctttgacgatatgaatgttcatttcatggcagttccggcagaccgcatgattgcagtcgatataccggtggctgtttacaaaatcctccacgtaacggtggtactgcttactacccgccacgacatcacggagatacattgtttttgcttcaacgagcaatgcgaaaaattctttcgctacatcctgttcttcaacaaaatggtgcagatgtttcttccctccaaaaagagagagggccattgttaggtcttttcatgatgaaatactttaaattggatttataatatattataagggtgttgctcccgaaagaaaatcctgccggaacaacaccctaaataagtgtttagatatctggtctgatgctcatcgcattgtcaatcgaataaaccgttagtcagatttactgcatcgtcttttttcttattgacgattttggcatacacttgggtcatctttacagatgtatgaccgagcaatttagatacagtgtataaatctgctcccaatgtcagcatcattgtggcgaacgtgtggcgggccgtgtgggaactcattagcatagcaacatcaaatagaacagcgcgttagaaacataatctgttagaaatgagctacatttcattatctggcacacctttctgaaacggattcagacggaatgccgaatcggttccgtttcttaaccgttaacaggttgtttcggaaacctgccgtgttaaccggatgattgaaaaaagttctccgacgggttgtttttctatgatactcagtattttgcgtagcgatgaacgcttacattcataataactttgcactcaaaaaaatgtaggcgtatgaaaattgagaaattcaaggtcttgctgtttttgaagaagaccgaacccgacaagtcgggcaaagctcccatcatgggacgcatcacattgaaccggacggtggcgcagttcagcaccaagctctcgtgcacgcccaagctgtggaacgtgcgtgaaaaccgtctggaaggaaagagccgcgaggcggtggagaccaatgcgaaaatcgagaaactgctgctggccatccatgcggcattcaatgaattgcaggaacggaaacgcgatttcggcgctgcggacgtgaggaaccttttccagggaagcatggaaacccagatgaccctgctccggctgttcgaccggcacatcgaggaaacgagggagcgcatcggcatcgatgtgtgcgcgtcctccatgagcacctaccattatgcgcggaaaacgctcggcgagtttgtcaggaaaaaatacaaggtgaaggacatcgccttcggtgcgttgaacgaacagttcattcgggaataccagtcctatatcgaagtaaaatgcgggtattccaaccagacctcacggcatcatctggccctgctgaaacggatctgccggatagcgtacaaggaagggttctccgagcggtaccatttcctgcatttcaagatacccaagcagaaggagaccaccccgaaggcgttgagccgcgaggacttcgagaagctgcgtgacttggaaatcccggaaaagcgccgctccctcgtccttacgagggacctgttcctgtttgcctgttatgccggaaccgcctatgcggacaccatatccattacccgcgagaacctcttcaccgacgatgaaggcagcctgtggttgaaataccgacggaaaaagaacgaactgacggcgcgcgtcaaactgctacccgaggccattgccctgatagagaaataccgggacgatttgcgggagaccctgttccctaaccagctgtacagtacgcttcgggcgaacatgaaaatcctgcgcgtgctggccggactgacgaccgaactcgtctatcatatgggaaggcactcgtttgcctcgcttgtcacgctcgaagagggcgtgcccatcgagaccatcagcaagatgctgggacataacaatataaagacgacccagatctatgcccgagtcaccccgaaaaagctattcgaggacatggaccgcttcattgaggcgaccaaagaccttgaactggttttatgagaaagggttgtaaaaacgagattggaaaaaaataaatgtagaacatcagctaaaatgaaccatcatgcgtagcactttcaagatattgccctatatcaataggaaaagaatcaagtccgacggcacgaccgccgtcctttgccgtgtgtccatcgacggcaaaagcatcctcatcacgaccggcatcttctgccgtccggaggattggaacagccagacgggaaccatccgccagccccgcgagaacaaccgcctcgcagaattccgcctgaatctcgaacgggcttatgaccgcctcctgaaagaacagggcgcagtcagcgccgaactgctgaaaaacgccgtgacaggtgtggcgaccattccccagacccttctcaaaggcggcgaagcggagcgggaacggctcaggctgcgtgccgaacaaatccattcgacttccacgttccggcagtcgaagaccacgcagctcaacctgcaacagttcctccagtcccgtggcctggaggacatcgccttttccgacatcacggaggagttcggccattcgttcaaactgttcctgaaaaaggaactgggttatgcctccgggcatgtgaaccactgcctgtgctggctgaaccgccttatctatattgcggtggatgagggcgtgctccggtgcaaccccttggaggacgtgcattatgagaagaaggacccgcccaagatgcgccacatcagccgcagcgagctgaaacgccttatggccacgccgatgccggatcccaaggtggagctggcccgccgcatgttcatcttctcctcgctgaccggtctggcgtacgcggacgtgtataacctgtacccccgacacatcggcaaaacttctgagggcaggctctatatccgcaagccgagggaaaagaccgaggtggagaccttcgtccccctgcacccggccgctcggcagattctggaactgtacaataccacggacgacacccgtcccgtgttccccctgcccaagcgggacatcctttggtacgacattcacgggctgggtgtcatgctgggcatccagaagaacctttcccatcacgccgcaaggcacaccttcggtacccttttggtctccgagggcatttccatagaaagcgcggcgaagatgatgggccatgccgacatcaacagcacccagatttatgcgcagattaccgactgcaagatatcgaaggacatggaccgtctgatggaacggcgcaacagccggaacgaaatgccaatggatgaataacaaaaaagtcaggaatcatggaacgttacattatcactttggacgaacacggcacacttcacgtgccggatgtttccgcaacagccatctggatgaatgaaccggaactgatggaactgttcggcgtggttgccctcacgctccgggcggcgataaaggccgtgtacaagagcggcatcctgaatcccggcgaagcggaacgtcgtgtccgccaagcggacgggtacgggatggacgtgctgtacggcctcccgttggtcattgcccttgccttccgccttcatacctgcggggcaaaacgtctgcgagaacgggtcatcggaaaattcacttgccacggtggacggaataccgcccgcctgttcatctttccggtcagtccgcattggcaaatggtgcggaattgaccgtattatcaactcacgcacaataaagcggcgcatcatgagaggattatctcccgtgatgcgccgctttcgtacattcctacaggtggccgggtcatttgcaagtgttttttgcaaataccggaaagggtggtccacttttcaatgcgtacacgacttctaccgccacctacatttttcccatgtccttctcaggttccgatacggaatgcctcccgataaccctccatcagcagccgttcgatatccgactcccggtacaggattttccctcccagctggatataagacatgcgccccgcatcccggtattcctgcaatgtccggcggcaggtcttcaacaatttggccacttcccggtctgtcaggtagcgttccccgcccaatacggggcggtagttttcggccaataattcaatgtggtccaatgcgtgctccagcattctgaacagcgcggccatctgtccgctttcccttgtcatcaattcgttcattgtcagtctgatttaagtgatactcatttaaccttcctcaaatagtttttcctttcaaggccgccagggtgcggcgttcctccaccagcggcacgatgcgccgcacgtcctccgcccggtagaacatcttgcgcacaatctgtgagtaagccagcgtgccgttgtcgcgcagcgtctgcaaggtgcgcgggctgatttgcaggatctggcacacctccgtgctgtccagccattcactgaggcgtttctcctccgccttgcggcagaacctgtccaccattccggccagccggttgaaacgcgccatcaattcctcaaaagtcttttgctcgattacgattacattttccataagattaccgtttaattgtgattatgccgcaaagtaaacggaattacgggcagagtccaccgcttgtcaggcgcgtggcagcatttggcgttgtcgtggcagccgttggcgttcttcgggtacatctatctccccatcattcctgttccagtccctgccccacaccttatatataatatatggtaaggcaagacaccttatgtaccttgagggatggaaacagcggcataaaagctttttcagacctgccggacgggacttttcaaaaaaatcattgccgactcggtaacgactatggaaaacgcctcttgcacaataccgatttttgcagcgtaatcatcaacaaggaacgatatggacacagagaaagtgaaacagaacccggccgtggaagcggcgggaagcagtggcgggcaagccgcaagaatcttcaagaaggagaatatcccgaagacggcggaaacggtcgggcgggacaccttcgaggaatggatgggacgcatcatggaacgtttcgaccgccaggaccggatcatctcggtgctggtgaacaaggatgccgccggagtgaagtacctggacggggaacggttgtacgacaaccaggacctgtgcgagatgctgaggacaagcaaacggtcgctgcaacgcttccgaagcaagtacaggctccgttaccaacggattggtcacaagacctattacaaggaatcggacgtgctggagttcatcagccaaaatatggaggaagtgctgcaaggcggtaccaaggtgctccgcatgaaagagcaacccggcatggaagccccaaagaacaaatccggcaaaagaccgggccacaagaagtattcacctaaaaaataaaagtaaaaatgatggcaacggaaaaagaaaacatggccatgacggctgaaaccagagaacagaaaccgagtatggccacctgcaaggaagccttggcggattacaggcggatttacctgcccgtgcctgccattgaagaccgcaagccggtattcctcagcaaggagacccgtgacaggctggaccggatagtccggttgttcggtgagcggaaaatgagcgtttcaggattgacggaaaacatcgtccgccgccacttggaaatatatgagaaggaaatagacgaatggcgcaagctgtgattttgataacccattaaaaaacatcgaaaaaaatggaacagaaaaagaaaaagcaagaggacgtgctggtcgtccgcgacgagaaaacgggcgagatcagcgtggtcgccgggctggacggcaagggctaccccaatacgaagcccgcgaagccggaacactcgcaggacttcctgcgcttcgaccgccacggggacatggtggacaatttcttcaagaacttctaccgccagtgcaaggagccgacgcgcttcggcttctatcgggtggcggcggatgcggtggacacgctgcttcccgtcatcaaggacttcctgaaagaccccgtggcaaacgcggagatacttgcctcgcacaaggtggacaccgccaagtaccagcaacaagcagaaacagagaatgtcaaacaagaaaaaaataacaacgaacccattaaaaagacagaagaaatggaaaagaaagaagaactgaaacaagagaaggatgttcagcagccacaggtagctgaaacacaggagaagcctaatctgatagcggacgaccaagtaaactgggaggaactgcgcaagtgcggcattgacaaggagaaactctcggaaaaggacctaaaagccctgatgaactacggcaagacgggattagtgacggtaaagccgaccttcggctatgagagttacgaattgcaggcccgattgtctttccagaagatggaggacggctatctgaagctgacaccccattttatccgcaatgaaccacgccttgacatcccccacaggggctacaccttcaccgaagaggacaagaagacgttgaaacgcacgggcaacctcggcaagcccgtcaacttcgccaacgagaagacaggtgaaatcaagccccactacatcagcatcgaccgcctgacgaatgaaatcgtggacatccctgccgacaaggtgcgcatccctaacaaaatcggacagaccaacctgtcaagggaagagcaggacatcctacgtgcgggattgcctttgcccaaggaagtgatgctctccaacgggcgcaagttccaagccttgttgcaggtgaacgccgacaagcgcgatgtggagttcgtgccgggacaaccgaggcagcagcaatcccagcgtcagggaaacggccaaggtaaggcgcaggacaattccaattcgccccaacagtcacaaggtgaagaagatgggaataaccagcaacgccgtaaccgctcgtggacaaacgaggacgggagcatccgccccatcaagaaatggaaagacgatgtgtttaccgaccagcagatagccgactacgtggcgggcaagacggtggtgctcgccaatgcgaaggacgaccaaggccagccctgcacgaagtacctgaagttcaacttcgagaaaggccgaccgctgacctactcgcagaaccccgacctcgcgcagaccgtcgcaccgtccaacgagagccggacacagctcgccgtgaacaacgaagggaagaccaacgaagcgaccaaacacgtgaaagagccgttgcagcagggtcagaccacgccgaagaatgatgcgcagcagaagcagcaggccaagaaatccaaaggcatgaaagtatcttcctgattgccgccactaaatccatccgataagtattgacgggctgaaacggggaacatgcaccgccttgtgcgcatatcccacaaacaatgccgtgccccgtttcatccccattaaagacaaaagtatcaacgaataaaaaaacagagaaagacatgattaccatattggcagaaaaaccgagcgtcgcccgtgagatagcacggattgtcggcgcgatgaaaagggaagaagggtatttcaccgggaacggctaccacgtgacatgggcgctggggcatctggtgcagcttgccctgccagacggctacggcatcaagggcttccggcgcgacagcctgcctgtcattcctaaaaacttcgagcttataccccgacaggtaaaaacggacaagggctacaaggcggacgcggcggcggtgaagcaaatcaaggtgataaccaagctgtggaacgaaagcgatggcatcatcgtggcgaccgactgcgcccgtgaaggcgaactgattttcaggtatttgtattcctatatcggctgcaccctgccgttccaaaggctgtggataagctcgctgacagatgccgccatccgcaagggattaaagaaactgaaggacggccgcgaatacgacaacctctatcaagccgccaaagcccgcagcgaagccgactggctggtaggcatcaacggcacacaggcgttgtcggtggccgccgggcgcggcacgtattccgtgggacgggtgcagacacccacgctgacgatggtctgccaacgtttttgggagaacaagcgtttccagcccgaaccggtataccagctccatttcaccacgccgtcggtgagcgtggatgaggtcgtgaagttcgcctcggtggagaaatggaaggacaaggaggaagccgccatactatataataaggtaaaggaacagatggcagcaaccgttaccaaagtcgaaaagagggaaaagatagagaaccctccgctcctgtacgacctgaccacgctacaaaagaaggcgaacacgaggcacggcttcacggcggaacagacgctcgccctcgtgcagaagctctacgaggcgaagctcgtcacctatccgagaacatcaagccgctacatcccggaggacgtgtttgacgaagtgcccatgctgttcgaccgtctggcaacccattcttcctttgcggagaagattggagccttggacggactgaaccgccgcagcgtggacgcctcgaaagtgaccgaccaccatgccctgttggtgacacccaaccgtccattggcgctctacaaggacgagcagaccatctacgacatgattgtggggcgcatggtggaagcgttctccccggagtgcgtcaaggacacgaccaccgtccgggcggagtgtgagggcatagcgttcgagacaaaaggctgcatcgtgcgcaaggcgggctggcggtcggtctatggcgaggacaacatagacaccgttttgcccgactggaaagaaggtgatatattggcaatgagcggctgttcgatgagttcgggcatgacacgcccgaagccgttgcataccgaaagcaccctgctggcggcgatggagaccgccgggcgcgagggcttggaggacgaggaagcgcggcaggcgttgaaggactgcggcatcggcacgcccgccacccgtgccgccatcatcgagaccctgctcaaaagggaatacatggtgcgcgtgaagaagtcgctcgtgccgacggagaaagggcttgccctgtattccatcgtcaggggcatggacatcgccgacgtggagatgacgggacgctgggaggcggaactggcggagatagaaaaaggcaggatgccgcacgaggcattcatccgcgacattgaaagctatacccggaaaatcaccacggaactgcttgcctcggacaagctgttcgggcacaaggcatcggactgtgcctgccccaagtgcggcaagggtacgatgcagttctacggcaaggtggtgcgctgcgacaacccggactgcgccctgcccgtgttccgccagatggcgggcaggacgctcaccgacgcggaaatgaacgaactgctggcaaaaggcagcacgggtgtcctcaacggcttcaagagcaggcagggcaagccgttcagcgcaatggtcacattcgatgcggatttcaatacaaaattcgtgtttcccgaagccaaaggcacaaaaaaattcactaacaggaaaggaggaagaaaataatacgtaccttttaataaagtaagctgcatctcggaataaaaaataagcgagcttattttgttctcccctcgatttgcattacttttgccactgattcatgtcataatctgtttcaattcgttgatactcgttattcacatggatttagtggcggcactcggagggataccgggtgccttttttcttctttcctatccattccacaatctgatttttcaccactaaatccatcagaaaatgaaacagaacaagaaaaccgtcccagcggaactgtcctactacgggctgtacctgctggactacctgagaaaataccatcccgacaaagtttccgacacgtaccttattgcagagagggaggaagctgccgccaccacctttgaaaaagaaaggtcggcaggaagtacggtcgagtatgcccacgaggaagccatgcgcgtcctgctgcacgggctgcacttctcgccctacgccctgctgcgcgaggtcgtggaaaacgagttcgccgacgaggtggcggaatccggccgcgaggcgttctgcaacgagctttatccctacttgacaaacctgttcgccggttacgacacgtcggacgacaccttcgccctgtcgcccggacacgacctgctctacacggagctggtgggaaccgtcatgctttatctggagtcctatggcgttcaataggaaacagaagatgcgcgacaacatcgaggcggtacgcacggcgttcacgctggaccgggagcggcgcacacccaccgagagggaacgtgcgctattagagcgttactgcggcttcgggggcctgaagtgcatcctgaacccggcaagggaactggcggacgccgcgcgttgggcgaagtccgacctcgaactgttcgcgcctacggtggaactgcaccgaatcattagagagaacagcaaggatgaaacggagtacaaacgctacgtggactcgcttaaagcctcggtgctgacggcgttctacaccccgaaagcaataaccgacaccatcgcggacgtgctgcacgacaagaaggtgcgccccaacctcgtgctggagccgtcagcgggcatgggcgcgttcatcggctcggtgctgtcggacaacccgcaggcggaggtgatggccttcgagaaagacctgctgacgggcaagatgctgggacacctgtacccgcagcagaagatacgcacggagggcttcgagaagatagaaaagccgttcctgaaccgttttgaccttgccatatccaacatccctttcggggacatcgcggtgttcgacccggaatatgccaacggctcggtgttcaagaagatagcggcaaggaaggtgcatacctatttcttcctgaaagggctggacgcggtgcgtgacggcggcatcgtggcgttcatcacctcgcagggggtattgaatacggaaagcaacggcggcacacgctacatgatgacaaggaaagcggacttggtgtccgccatccgcctgccgaacaacctgttcacggaagatgccaacacggaggtggggtgtgacctgataatcctgcaaaagaatgaaggcaaggaggaactttccgaggaagacaagaggttgggcgatgtggtaaagagcaaccacacgaacattgtttccaacgggtatttcctcgaccacccggaacgcatcatccataccgacgcgaaaagggacaccgacccttacggtaagcccgctatggtttatacgcacagcggtggtgtggagggcatcgcaacggatttgtaccaaatgctgtcggcggacttgtcggcacggctggacttggaacgctataatggcatcaaggaaaaaaggcaggagactcggcagacgattgtcgtataaatccggaaaaaccagacgtgccgcttaacaaaaacgatgcgtttcaaaaagtacaaaaacgacgcgtacaagaaaaacggtgagcgcggtcctattcagcatgatcaaagcccaccgtttttctttcacttgaaccctctttaaatggctttaaaatatcatttaaaagccattgcagattcaaaataatttcctatctttatgcaattgttaggctgctatacctgacacctcatccggcttcgtgtacagcatcatgtctgtatatttagcttgatagtttacgcttgcactaaactccactttcctgcattccttgaatgggctgccgacaaatgggtttcggtccatccagtcgcacagttctaaaatggaggacttgttcgaggtgaagtacacgaacgaatgccctttcagaacggttagtacatccagatagtcagccagacgccagaacatcttgtaagtacccacctcggtggagaggcacggcggatcaaccaggaacaccacacccggaacatctttgtaacgtttgaatacttccttgtagtcttcgctggttatagtcagtccttccagataatcctttgcttcgggatagtctgtctgccgaatcctattgtagatggcttctttcttcattccttccaaactggtcacatatttcatggcgaacaacaaggatgcggaaaccgtgatataatccacgtaaccgtgctctttttcttccctctcaatacgagcaaacattttatcgcgaacctccccggttatacgtttgtttctgggttccccttcagctatccgacgcaaatcggataacagcacattggtggccgggatatttacaagtcggcagcggtagttgtcgaagtcattatacacaacggtggcatcaggcctgacacatttggtaatatgtgacagcaggcccgagccgccaaacaagtccacaaacacggtgctgtccgggaactgtcccagcaccttgataaattccctcgcaaacatgcgtttctgccccacgaaaggaagcggggcggacaaatacatctttctcatttcattctgctttaaaacggccgcaaaggtccacagaataaacgaaaaacagcgggaaacatgaactgttcccgctgcaagacatatacagcaaactacacgttcaacccgaagcggaccgtctcgtcaccggcgatcagcgcacgggtgcccgggatattattctcgtagatatgtacattgcccagatagagagtgatcgacttcaagggaagttctatctgccgcgccatcaggtacaggtggtaaatatcggaaggtagcccgaggtttgcgtcactgctgcgctggtaggcggacagaaccagttcaccgccatctaactggaactgtaccagactcaaacagggtgcctggttgctctcggcaccggtttcgcccagaaaaagcacgtagttcttgctgttgcgcctctcccggttaattttcgctatcaacggaggcagcttctcgaaataggtcgggtaactgttcaccaggatggagccgcaatagtcccaccagttgatgccggcctcccggtacttctccacgttgcgctcaccctgcataaataactgcaactcgctgcggagcttcttgcgggcgatattatgcccctcgaatatgtcaagcaggtccgccggtgtcagtgacagctgctcgttcagaaggtattgtatatttcccttcttgttggtctgtgtttttcccgtggcaagaatcttgtccaggatacggtaatacttgttcatagccatttcctccttctaaatttgaaacaccctaaagataaggggaaacggcactccctacgacataaaacaacccgttcacactgcaagcgtcttgcagtcgctctggaatcgtttcaccaaggcataaaccttacgttcgctcaccgaatacttttcggacaatacggccacagcatacgagactttttcaccttgatcgagtaggcgggtatagtccgcgtacaggtcgatataccgggcatcttccagacggatgccggccgcctgaagccttttcaacagctcccggttaaagtttaatatctcaatcactttcatacaacaaaaaaattatatctttgcatcgccaatcattttttagacaacaaaaaaaacgtcaaaccgtgacagagggtatttgcccccggtcgcgcggtttggcgtttcatgtttataaaagtgattggcgttactttttaacaggccgggggcttttttcttatcctcccccgaaggatttattccacccggtacttctccggatcaaaagcgtctttcttcctccagccgtcagacagcgtgtcctgaacatgcttcatggctttcgtgtagaaatcggtcagttcctccagtgtgacgaactcccgatattggggaacctcatccgtaccgaacttgaatgtcacgggaagcgtagcaccaccagtctgtacggccagatcatacgctgccttataattgaactggttttcacttgacagccataccggcataccttcatagagaaaaccggaaagtatctcacggtcaatttgctcattacaccagtctgtaatgacggactttatagtatccatgtgaggtctgccgacaaagccttcctccatgtaggaggcggatccgtcctcacgttcctgtacatcccagcggatgcgccatctgttgcgtgccgggctcacgcactcgatcagttttatcccggatgttccttctacccgtttcatgtaaatatgtatttagttcgacccttgccgaaggtttccgtcttgatggtggtctcgaacgggaagccgtcgggcatatccttcacttgcaagaggatgttcttcatctcctcgctgttggtaaagaactttttcggttcaccgttcatctcaatggccacgatacagcggtcctcgccctgttcggtcttgatgcccgtctcgaagtccttcaccacaatcggtaagttcaccagctcccggatgcttaccaccaccccgggaaaacgtttcttgccgtcctccggcttgtaggaaacgttcaagtctttaaatgatctcatgtctttgcctgttaattttttaaacaacgtatgacagtcggcgtgcttggccatcccgtagaacgacgctatcagctcacgcctcctccttctcgattttacctcgtgcatttttcgggcgaacttctgcttgatgcgcttgcgaaggcggacatggtccgcaccgaaagtcacataccccagaaagtcgatgccctcgcccggcgggaacacgcgctcgttccccttcaccaggagaccggcacactccatgcgcccgtggacggcatcacgaatcttccacagttccgctttcgttttacccagtacgacgccgtcatcacaatagcggtagaaatgacgcacggcatacctgtccttcagataatggtccagatacacagacaaaagcaaattgcccagcccctgcgagctgcgcaggccgatactcagaccttcaggcatcaggcggataaagctctccagcatggtcacgagctttgcgtccttgaacacccggctgacgcaatacatcacaaaatcctgcttcacgctctcgtagaatttggtgatgtcaaacttgtaacagtaacgtgtaccatcagggtcttcggccatgtcacggcggacatacgccaggaggtcgtgcatcccccgtctcttgatactggcggaggtggtacggatgaaacgtttccgcagatggcggtccaccaccgccatgatggcatgcacggcgatgcggtccttcatcgggatcacctgaatgcggcgtagcttgccgccctcgatgatctcgcgttcacggtagtccttcacgcggaaagtaccggatgcgatctgcgcgaccagctcctccaacacctcgggcttatgcgcgagcagatagcacccctggcggctgcgtttacgcttgctgccgcgaaggacctgccggaaggaagcctccatgttggaaggctccacgatctcctcgatgatatacccaaccctgcgcataaattactgtttattgcttttaatacggggccttcaatcccccgggcccggcttcttcgaaccgtttccggcctaccaaaccctacccgacactttatttttcagttttccggcccttacggaccgctgttactgcggcttgcccccctcggcaccacggtggggacaagtccccggtgttgtacgccgattaaaatttcctttcgattgttgttcagacgagaaccgatgttcgtgttcgtattcgaggaatcgttgttcgcattcgacatcgaaacaccgccattcgggttcgcgttgttgttgccacgatagaccacacggcctatggggaggcgccacctttcaaatgcaaaagtactattttcaaattattatttaacaaacagatacaaaacctgacgtcaaaaaaatatttttcgacgggctgacgcccgtaatgaacggcgttcccctgctcggggaacaccggatgttttgtcgcttcgctcccgctttgacgctttacgcggccgatcatgcaacctcgcttatcgctttaaacgccacggcgctcgacgccttaacgagccggccgcggaaggccagacgagaaccgatgtgcgtgctcgtatacgaggaatcgttgctcgcatacgacatcgaaacaccgccactcgggctcgcgttgtaggcgccacgatagaccacacggctggaggcagtggatatgtagtagatgtcgcagtaatttgtcgaggaggaacccgaaacggaacccaccggaatcacgtccatatatttgccatgcgccacggcggtaatccagataccggagctcacggaacccttaaccaggcgggtactgccgtcaggcatccagatgcgccacttcccggaattgcccgtgtcattaggaagatccacgccgtccatcatgtcatatttatgaccatagatgtcctcgtagccaaggcagcaaatattattcacctgcgtaaccgtggccccgccgtagtcatccttctcacggtaccacgcatactggtggacggagttttctatcaggctgttcgtcacattagggttgattgaggaggcttcctcgtagccgatcgtgtccgtcataccgcggctggcagtaccacccgtagtacggttgttcgtgtgagagcccgcgccgcattgttcctggctgtcacgacgaccgtacttcgcgtagaaaagattcgcgatgcgcgagtgcataagggcatcaatctgctgcataccgcgctggacactgtaatagtggaaatcagcccaggtcatgctcgccgtagtgctcccgccggtaatgcaggcgcgaagtttggaaccgacaacactgctgcccacaacggcacacaagtgctcgtcattaggcacccattcgggttccatatcctcgatcctgtcactgttagaaaggacaaccttatcgaactctgccgtgttcagaatggagaagtgaagagcagtggcaccctccggaacatcggcaatcaggtacataccggcctcgaacttgttgctcaaggtagggacgacgattgaactgatgaccgtgccggaatcgtctgtgaaaatgcttccgacaaggcttgtaccgggaacgctcgggaaacgcacacgcttgtaaccgtccacgttcaccttgcataccgaatacgtactgtcagtactgtagctgttcgaaagcgtatcctttccgctcatgatcttacgaccggaaagataaccgccactcgtgcccttaatgtcgtcaagcgtaaggacgtcagcatccggaacggaaggcatgttatccgaaccgttactgctgtaacaggagtaatgcttgccgttcaggtaatcattgatacccttgctccagaagaagggctcgtacatcatccagtcaccttcagtgccgtccagtctggcagccgtgccgtcggcgtacttgttgctgtccgtgtcgtccagcgggtagtaggtcatctcaccgtccaggttgttcaccgtggtatcaacgttcgccatgttcacaccccgcgtcgtcgcttttttagtcactttagcaagtacacggtgacgctgcttcaggatggcggaaatatgaccgctcacctcatacgcgttgtcatacttgtagccggtaccgttgtcaaggttgctcacgttcgcgtcatccgatacctcgtcgtcgaactcgatcatcgtgtattccggctgccggatattcagttccgggaagtgcgccttcagagcgctgtacgtatcgtcatcaatgtagcgcgtgagctgtaccgtacccaccaaggcgcacgtgtccgtagtgttgccatcggaatccacaccgcccatcccgacaaacttatccagccacgtaccgtcatcctcgcggtcaataccggttactctgatacgttccacacccgtgcaacggcccagcagggtttcccagtcaatacctggacaactgtcaaagatgaaggtcttcaccttgctgtagctttccaatgtcagcccgccggtggtcagtctgcccagatattccagacggaggctggtcagtgtaccgggaaggtggagcagcgtcacgggagaacccttggctagcaccacgctctgcacctgcgtaccgcgggcctcaagttcttccagcttggtctgcgcactcaaatccagctcggtactggtacttcccccggttttcgcctgtgcttggttacgaaggttgagtttacgtagctgcttgcagttgccgatgttcaaccaccagccggtactgccgttgccggaactttgaaggttcagttcgcgcagcacggtacatttgcccaggtcgaaagcgtttttcaggtggtcggcggccccgctcatatccagcaccttcatacggctcgcgccataaaccctcaagggatcgttcaccgtataggcaccggtgatggaaaggctcgcagccgcatctttcttgatgatgccggtattccctatattcgggctgttgttcgtaccgtagccgaaagcataaacctcgttggccgtaatcttcagcacgtcgggggtgtcagcagccgtacgtgccagatagaggtcgatgttgtcactggtgaaattgctcgtgccgtacttagcatccagaagggcgaaacgattacgcacgaaatattcacggtgcgcacggttactgccctgaagggcgtagatgaacggccacaccttgccgtacatctcctgcgtggcgggcaggatgtacttcagctcgccgctcttgttataggcacggtcgcaccagttgcccgcctgctccacgttcagcatgtccaggacacggctggtggtaagtacaccgcgaagagcctgcgcctgtgtcttcaggtcagcgtccaggttggccagaacgaggttccaaagccagctgtcacggccttcaaaggcatatttcccggcctcggcgtcataagtgtcgcggtcggtggtgtagtcatacaccaggaaacagtcgttacgttttcccatctgggtatcaccgtcgtagtaggtgatgtaccatatcaggccgtcccacgtgcgcagcatcatgttcttcgcacgctggtcaacggcaaggaaatagtccgtccagaggtaatacgtcagcaggaaagccttgtcgaaatagtcacttatctcgtccctgaacttctcgctcttaaaagtggagaggtcggcgctcgtcgcaccgtccggaacacacgagcgtatccatgcgtacagccgtttcacggccgtacgctgcgactcgtcaaggcccgcccatttcacatcatccggaacgttggtctcggcaccggcatcaaacacctcctccagatgagcgtcacttgtggtcttgaaaaggcacatggcctcggtattgttcagcatttccagagtgaggggacaggcaggatcgtaaccctccacgccactaaggccgaacaggtcgccgctcttgcttttctcgttgttgaagttgtattgccccacatagttgttctcgccgtcctccgcagccgccacaaacatgtcgataggcacaccgtcgatagcggtacgcacggtgaccgcgttcaaatcgctgccgcccgtctcgtactggtaacgctgcggaggggtgagaagccccatctccttcagcacgtcgttgaacagtttggcaccgcctgtgttcagcgacatggacgagtcggaataatcactcttcagacagatcaggttcatggcgatgccaccgggacggacgggatatttcttttccgcctgctccttgccgccaacggtgaagctaaggttcgtgccgcccttgctgatatagatacggatgttcttgctcggatatttcgtggaactggtaccctgaatacggatataacagtcacgaagcacgaagtcgtattcggatccgaaaggggagtaatagaagatatccgccgaaaagtccgtcttcttgttgttctcggcatacacgtcatcgagcttgttctggcgcacgatacgcagcacccccttgcccttggcacgcagcttgtccatatccacagtgtcggtatcacccaggatatcgttctcctcatacagcgcgatcatctcctcaccgtccgcactgtccaccatccggttctccagttcctcgtcgtcactcaaccggcgggtatagatacgcacgctctttacctccacgtccgccccggcgctgtcaatggtgatatatttcggattgtcctggcggaagctgaaggcgttgtcgtagatgtcggcaccggtacggttgccgtccacataaagctccatcagacggctctcattgcgggtacccaccatgagggccaccttgatccaccggtcttccacataattcgtgcccagcttgatctcacgctccaccagctcgtcgtcctcgttggtataggacactttctcaccggtcttgaaactcgcttccgaaggggtgatataaagccccttgccactgtcgagacagtccacaactgcggtatcgctgtcagtgggattgcttacccggagggtcagttcaatggtcagccccgtacttttcacatcggtggcaaagggccggtagccgatgacggctttcgcaccgttggtcagcttcagcgcctcacccgtccagccgttgctgctccagtcaaaaccctcgaacgtggtctccacgccgttcgactcccatgttccggggttactctccccgttgctgcggcccgccgcgtcaagcttgaccgccaggccgtaggtggcctcgctgatatcgataccgctctcacccacgtcgatgcgcaaagtgtacccggtcggaccggctttcaggacaagcgtctgcgtgccttcctcggtaaaccggttactgtaggtcatcatgctgcggggagcgctcacggtactgctcttgacgccgtttttccagaactccacttcagcgggcacacggtcgggatcataggccacccagtcgaaagtgagcttctcgtagcggccggcttcaaggaccggctccagatgctcgtcccgtccgaggacatgcccgtcggcatgaatgagcttcaaaccgatgaagggcgcgccggttccggccttcagcaggtcgatatggatgctctcgcttttcagcgtgaggtcgtcagtttccatctcggccaccagctgggcggtatgccgccccacggacaggccggtcatggaaacctcgaaactgccgttcgtcgtgccgctgcgggtgaccgtatgcgcgttctgctgtacaccgtccacgtacaggctgacggttttcgtgccggtaccgctcacggcgtagggtatactcgcggaatcataggtaccgtaaccgccgttctggatggtggccgccaggttgtaaccgcaggaaagggacagggtgacgctcttcacgctcacgtacgcctgcttcttctgcgccttgcccgtggtgggatcggtagtctcggcaatgacgtagatatcgctcgtgcccaccagcaggtatttggtcaggtcaagggtataggtacccttgctcacttccttcagcgaggaggaataagtggtggtcgtcccgcgcttcacctggatggtgacggtcgctttctgtccggtactgctacccttgtcatcaccgccggcaacctggtggtcataggtataggtaagtttcaccgctccgccttccttcacggttttcttgtcggtctcggcaagcagcacgatcttggtggtggaggactcaccgccgccaccgctgccggccgggatgtcaacgctcgcgatctccgccccgctcttgttggtcagcgcaaggcggacactgctctcgtcgtcgctcacttccgcgctcatgccgaacacggtaccggcttccacctcctggaatttggcggcgacggtcttgttctggacgggattggtactgtcggcatccaggctctcgtccacttccagcttgtcgatggtcagatccacgttgccctcgctgtcgggaactttcttctcgccgttcaccgtcaggctcttcatcgttccggcaccgccgaagtcctcccagctcgcctcctgctcccagctcgacagacttgtccccacgaactgtttggtctcccatttgccctgcgagacttcataggtgatgcaacggcccttgtaacggtatttctcatccacggcaccgatcgcggaggaaaggacataataaccgctctccaaagggacttccgccgtcacattatacgtgttaccgccaccgcccgtaccaccgggaatatcaacggaggcaatctccgtcccggtcttccccagcagggtgagtttcaccgtgtcgttctcctcatcagggacggccgtcatgccaccgaccaaaccgtcgttcacaccggcggcggaatcctccgcctgtttcgcagccgcggatgccgctgccgcggcggaatttgcagtttcagcagcctgattggcggtaccggccgcatcagacgccatacccgcagctttattcgccaaagccgcagcattatccgctttcgtggcagacgcattcgccgtggcagcggcatcatcggccggtttacgcaaaagggtgagcggagcactcaccagctcactgccgcgaagggcggggagacttttgatattgtcaagggagctgacctccacaagttcatcaacgctctggctctcggccttgatagcgttcaggatgtcgttcttaagttccgttttctccgattctgtaagtgccataagttattcctccttttttattgttgtcagtcattgtaataatggtatgaaagcgcgctgaagccaaggatgcaccagccgcacttgttcaggctgttaatgatggcgggctcctcccaatcctcgcccgtgtagagcaggaggaagcggttcacggaggtgacgtacagccagttcctctccgggttctccggagaggaagaaagctctcccttccacgtgatgcggagatcatcggaagcgccgccgtaaacggggaactccacccacgcgccgtaccagtaaaggtagttgcggttccttttcgtgtcgtagtaaagccatccgctcgagggggaagcggggggaccggccgacgctccccgccacgaaaccaggtccgcaaggattctcccgttcagctcgggggtaccgaccagctcgatgatcccgctgatccagtcgatcctgtaggggtcggaataggaaagcagcgaatcactgctaaggttcacgttggaaccgcggagcagcgtgccgtcgtccacacggacggagctgtagcggatagagcccaccgtacgcgtatagggagggtggcagccgttgtaaagggttacgcgcgagccgatataacgcacgtcgttcggaaggatgatgtccgcaccgttcgacgaaccggccatgtccaccttcaggctcagctcgcggccgatcaggtagccggcctcgccgcggcccgagcaggaggtcaggacggcgtcgctcgactccacaaggtggaagttcgtgcggatatgcccggagaacgtgcccgcgttcgcctcgatgctcccgtcctccaggatcttgaaattatcgttggccgtcacgaggccctccagcttgacgcggtcaccggtcagcttcaccacgctgatcttgttgccgtcagcgtccgtcccgtccacactcacgccgataagcgccagtttcccgtccgcgtcctgggcgtagatgcccgcgccttcaggcttcaccacaagccccgtctcttccagcatattctcgtcacggtcaaagacggcggccgttatcttcaccagacgctccgactgctcgaaaagcgtccggtagcggtgtgcaaggctctccaccttgtcagtggacagcacgagcatatacaggtagatgtcaccggtaaaggacagtttgaaatcaccggtaccgttccagaggccgctacaggtgtactgcacgtaaccatcagttgcagacagttcctcctccacctccaggctgttgaagttcgcgaaacccgtcttgtcaacgtccaggaactggactcttagagtccctttggttgcgcagcggtagaagaaggaaaggtacaccggcacggcctccttctccccgtcaccgttcacaggcatggaggggatgcttttcaaattcgcccgtttctggaggatgtacttgttacggatgtgcaccaccgtccgcccgtcatccaccgtcacgctcgccccgtcgccctttctggtcagtacgttgttgttcgcccagatccatttgttacctgccaggaagaacaccgtctcgttctccgtgttccatttctccagcccgtcatcgaaggcggggttgttcaggtagcccttctccgtggcgaagtcgttccttagggcggtcaccgcgctggtgatgcgcccctccacgatctcgaacttggtcttgatgtcctcaccggtcaccagaaggaaagtcccgcgcaggtaggcgttgtcgctgtaaaggccgttgccgtgcggctggttgtcagccgggaaccagtcatcgctgatgccgtccaggttgcccaggcgcgcacgaaggcagccggtgaagttcttcgccttcaccccgtccatcacgtccacgcggggctgaccgtcctcggtggcggagatcaggatcaggttctgacgcagcgggttctccgtgttgcccatcagcacgcactcgtcaccggcctccggaagggaacctgaaaattcatcctcacttacgagaatggagtcaccctccacgccggccacctccacccagtaccctttcaggttcccgccgctgaacgtggcgcagcgcatcaggtcatgggcctggaaactgttgtcctgctcgaaagtgatcctccagtaaccgtcctcaagtacggcggtctttattttcccgttggcggcgctgacgcacagctggccgccaacgctgcgtaccttctcgataagcagctccaatactaccatgacctggcgtaccgtcagcttgtcgatggtaagatgggacaaagcgtcctccatccacagccgccacccctcaccgaaaagaccgtccacgaatttcgggctgcgaaggaactcacgcacgacaagggtcagcaactcggcattgcccttgtcatcaatacccgcattatcctcctgtccgaaagaggctcccgcttcgaaggtgatcttcccctttgcacggtcattcttttttttgctgatgtgttccgcctgacttctccgcgcggaaaaaagattgttgtccgtaggcagtgtcttgtcccagctacggataatgtcaggaagcgcggcaccctccgcctttgacttcgtatagtttttcagttccccgatactgtcattcacccgttcaaacgcaccactatgcagggcatcgctgatctcgatgtccatctccccgggttggttcaccttccgggtaattttcgtgatgcggctgctgcgataaccggtttcggggaaatactcctcgctttcaagtctcacacggcggcctacggacagggaaacaccgttctcctcaatccacacatggtcggtcggggccttgtaaacggcaagatcctgccagcattcggtattgaactgttccaccgccgtaagaaactcctcctcggcaagcgggtaatattcgtccggcatacggatattccagagaatataacggtcaccggatttcggaataagtttgccgccggggagttgcgtgtcatcatcatagggccatatcgtaataatctcgaactcacgggtggcactgttgaaattcacctcgaaatagtggtcctcaccctgccccagtccggaaaggtcaccgtcctggaacgatacacgtttggtctcgtcgggcagctcgtaatcgttcggatcgaaattcaggctgtcgtccctgaaataatagaccgtgaaagggttgccgtcgtcatctttcacatcttcgctgcgcacactgctgacagccccgatcctgcggggataaatgccgctgaaggcgtcttgctcgtaacggtcatagatgccgtactcctccgtatgtatctcgacatattgcctgccccccggaagcatcaggcggctatgcccgtattttgacggatctatgttccgcgtgctgcctaccgggaacaaccgggtataaaaattgtcggtacccgtcgtgtcgcgttcgattccggtcagtcccttcccgtagcccagcgttatttcctcgccatgctcacaccggcacacgttcacggtctggccttccacccaccattcagcctgcccgccgaccgcttcggctatctctttcagggcttcgtcgcagtacatcccctcgtagtctatcgtgatcagctccgtaccttccaccgtacccgtcttccagtcagtaatgtggcccatgccgttattgatagccttcaccaccatcgccacatgctcgcggggcgtggccgtcagggtaaacagggggttggtgtccccgtccgtcgtctccagcaccaggaaccgcttgatcaggctctcgataccgtacagcttcaggttatactcccattcaccatcgctcacctgcttcggcgtgtagcgttctgtcagccagtaccgttcgcccagatagtccgtgtagtcgttcacgtccaggggcaggaaggcataatagctgaacgacagggaaagcacattgtctccctgcacttccttgctttgcgtcgagctgtcgttcacggccacatccgcacgcttggttccggctttatcatatatcgttagaagcatattctaatagcgtttgaatggttatataatcggtttcggttcccggaactttacccggaactttccggcatgcacaccttccgtccacagataggtcagcggggtgaacttcgtacagtcggcatacttcacccgcagctgcagatccagctgggggaaacggatctccagccagccgtccttcccttgcttcaggaaattcacaaaggcaaagtactgcttcatccagcctgcctgggtcttgttgtaaagcgcaaaatgcagcgtcacgtcacgcgcttcattccgtggggtcagcacggggctgtatttttccccgtgctcttcccgtatgtccacagccgtatccttcttggccttgctcggggtcaggatggccgtcaggttctccatgcccccgcgccggtcttccaccaggaacacgccgtattccgtccagatgtccgtgccgttcaccagcaccagtccgctcagtatattgcccatatcacttcacttttagtccgtcacgtatcattttctttatcacttccttcagttcgcccaggtgtccggcgctcacaccggtgttctcggctatccgggccagatgcccttcagccgtgtccatcttctccaccacgctttccagccggtcgtccatgctgctccagtgctgcagcccgccggtgaacatgccctccagcttcgtgccctggtcctgcgtcatggccgtaaagccgcccgctttcgcactttggctcgtaccgccctgctgcgtcttgtcataaccggtggctgccgccaggttgtcacgcagggcaagggcttcatccatatactgcatgtactcttccatcagcgcgttccgttccgcctcggtcagttcgttgtcctccatggccttgccgaacttctcccaccagcctttcagtttgtcgctgtacatctcaccgatcttgttgctcagcatcgcttgcatgaagtactcggatatatcctccgccgcatccttggcaccgtacttcatgttcatcaggttgtcgatgaagctgctgtacataccgtcgaacgaaatgcccgtcagcccttcatacagctggtcggtcagttcctccagcttgccggcctggtctatgtagtcatccagtttctcggtcagtcgcccgccatagcctcccttaccggtattctggatttgcgtccacatatccacgttgctgcgcagtgccttcatttcctccgggctcaggctccacaggttcccgtcccactggcggccgatctgtccgctcagtttgtctatctgtgcctggttgaaaccgccccagtagtagttccagctgtggtgacttccgctgtagcgtgcctgttcctttgctatctgcagatagtttgcattcgtttctttttggtatttgtaagcatcccggtaagcttccaccgattttgtccccttgcttgccttgcaaaatgcttaattataaacgttttacgtttaattctcgtcattctgttttttattgcatttctaaatattacttatcttgcgcgccacactctacctctatcctctggcccggagctacaacgaagtgagccagcttcccaatgacatccgcctttatatcacggacgagaacaatgtgctggaggactacgtatacggcagtgacggcgtaaccgtacagaccggcgacctgaccatcgacgagatgtacgggaaagagacctactactccttcgacctcaccgaattcatccgcaacaactacggcacttcgggcatcaagcggcagaaactgctgatgagtctgacagacgaagaaagcaccaccaccttcaaccaggtcatcttcaccaacgaccccgaacaagaaaaccaatgcagattagacgtaagattcaaaatatacaacgagcaatgaaacgccattactggattccccttctgctgtgcagtctgtgtacggcaagcctcaccgccgtggcacaaaacaccaccaacctgcccacctccatgtacggagtgggcgaactgagtgccggtgacggcggacgttatgccggcatgggcaacacgggcatcgccctgaaccgtaccggatttctgaacacgctgaaccccgcagccatcacccgcatggacaccgcctgcttcacgttcgatgtgggtgtatctgcctcatatgcccgctactccttcctgagcgaacacagctccaacttcaccggcaaccccaaccgcatcagcatgggcttccgtgtcctgccgcgctggtatgcccttgtaggtgcagcaccatacagcagtgtgggctatgtcatccagaccgaagaagagatagagggaatgcccggcaactacacctactcgctctttgagggtacgggcggactataccggtgctacgtcaccaatgcctttgcactgagcaggcaactgtcggtcggcatcaacctggggatgatagtgggcacagtgacacagagcgaaacgcaggaaagcgccgtcgtaaagtacgaatcctccaaacgggccttttatgcggacttcggcatacattacgaatggggtgcgaccggacaacggaagtgggcagcagggctggtatttgctccctcccttcccatcagccacgacaatacactgacctacagcaactcatctaccagcgagaacctcaataaaggataccacagccgtacacaatatctgcccatgcacctcggcaccggcctcagcatggccaccgaacgctgggtgctgaccgccgactacaactacctggactggagccgcaactcctcttcctatacctccatgaaatacgagaaccagcacaaagtgaacataggcggcagctacattaccaagccacgcctggcacgttccaccgagctgatgggcggaataggtttcggcaactcctatatcaatctgaaaggcgggaagatgcagtatctggaagccagcgtaggggcgagcttccccatccggtactcctatctctcgctgggcgccacgtggcggaaacaactgaactcacgcagcaatctgatgcaggaaagccggttcagtctgaatctgaacttgacgttcggggaaagaatttcgagagcaaaactaaagtaatacaaggttccggttcaccacagattacacggattttacaccgaatgattatcatttgttggatctatatatgcaacgcgttgcatatatagatgcagcacgctggaactatagatccaacaaacaaagtatatagtatctgaaaacggggtattacaacactgccagcctggacacatacccttttaccctttcgcggtaagcatcgccaatggggacatccttctgctcgatgagcagtgtgctgcgcccgatggcgctgatgcagtccatgcggacaataaaagaacggtgcacgcggataaattcgtccgccggaagtttttcctccatgtacttcatactgcataggctcaagacaggtttggaggcacccttgcagaaaatcttgacgtaatcccccaaaccctctatgtagtttatccgctccaggtcgagccgcatgatgcggttgtcacaccgcatgtaaatcaccttcggagtctcttccagaccttgcctgtgcttggagtcggacgtacctgcatcttgcaaagagaaccagcgtgccgccttgctgacagactggaaaaacgtggagaaattgagcccgtccatcagatagtccaacgcatccaggcggaaacactcggcagcatacttgtcggtatctgtaatgaaaatgacacgagtggacgaggacaagagcctgcaaaaatccattccgttgatttcaccttcttccaccggatagatgccgacaaaataaacttccacttttgtctcataataatccttcagcgcttcaagaggattgccgtactttccgtgcaaagagagaaaaggaaccttgtcgatatactcttccaaccttccggcaatctccgggtctgcatgtaaaatggcacaattcaaattcatgttcgtttcttttttacatgatggacgctgccatatccgaaaaactgcaaacagaagagctaaaattaagctttatttatgattcaaagattacctgcatttacagaaagactaaattatcaggaaaataaagtgctcactatgaatagtttcaaaaaaataaacttatctttgtacgtacatcctcacaaaaaagtaaaggctatgaaacaacagaaactattccacctcgtattgtccgccatattgattgtctgcacgaccggctgttatgataaagacgaaattaaagatgctgaaaaatatctgttcaaagatattcaatactcttttgaagaagaaggggatggattcagtacctatgatgtagaactcctgcctttcatcatggaaaacaatttgaacagcagtattaccaccacaaactccccctttgaagacacatggcaggaaaccaccttccaaagcaacgaccccggagcatttgcatggatgggggaagaagacatattcgtcaatgccccttacatgtttggagatgaactatcgttaagcgggacaacaataaaatatggcagcgaaacaacaaaagccaaaggtccaaacagcagtacttccaccatcagcataccacctcactgtcggctcatcataaaaggaacactacactacagcaagcttgtagctacctatacgctgacattcgtaggtgaatatacaaaaacggaaaaacagataaagggaaagttcatacaaacaactccggaaagctacacaggagacattaccatgaaaccgataacggcagattaaaacggaatcacatacgtgggcacaccatattgctcatcctctccgttcctccatcaaccggatgaattcctcctctttgaccggaaacaatacctcgcacttacccgctccatacttcaccagtacgtagcgcattactgcaaaccgtcctatctgcatggaagaggcacgctccacggaaatgacatccttcagcagaatctccttgctgcgcgagaagcggccgaaatacaatttcagcttcccgtccggagtcaccgtataggtagtatgaatcagcttctcgatgacaactatcagccaaagcatgaaaagcgccgcaggcagcacgtatttatcccacaacatataaatggcaagaccacttatcagagccagaaacaaaaactgccctacagcaatacgggcatgaaagattctattcattctatcggatttttgccgctaaggtaggtctttttacgaataaatccctacggaatgaacaaggaatgtacttattttgtagttttgcagcgataaacactaaatcctatggtaagaaagttcaatttcctcgttatcggctccgggcttgccggtatgagttttgcgctgaaagtggcgcacaaggggacagtagcccttatctgcaaggcaggtctggaagaagcaaatacctattttgcacaaggaggtatcgcttccgtcaccaatctggctgtggacaacttcgagaagcacatcgaggacaccatgattgcaggtgactggataagcgaccgcgaagccgtagagaaggtggtgcgcaatgctcccgaacaaatcaaggagctcattaaatggggagtgaacttcgacaaaaaggaggacggagagtttgacctgcacaaagaaggcggccactccgaattccgcatcctccaccataaggacaatacgggtgcagagatacagaccagcctcatcgaagctgtgaagcaacaccccaacatcaccgtactgaccgaccactatgctgtggaaatcattacccagcatcaccagggaatcatcgttacccgccatacccccggcatcaagtgctacggtgcctacgtgctgaacgaagcgacgggcgaggtggataccttcctttccaaagtcaccatcatggcaacgggcggttgcgaagccgtttaccgccataccaccaacccgctggtagccacgggagacggcattgccatggtctaccgtgccaagggagcagtgaaagacatggaattcatccagttccatcccacagcccttttccatccgggagaccgcccctcgttcctcatcaccgaagccatgcgtggttatggcggcgtgctgcgcaccaaagacggaaaagaattcatgcagaagtacgacccgcgactctcactggccccgcgtgacatcgtggcgcgtgccatcgacaacgaaatgaaacagcgcggtgaagaccatgtgtatctggacgtcacacacaaagaccccgaagaaaccaagaagcatttcccgaacatatacaagaaatgcctcagcatcggtatagacattacaaaggaatacataccggtagcccccgccgcccattatctctgcggtggtatcaaggtggacttggacggacagagcagcatccgccgtctgtacgccatcggcgaatgttcgtgcactggactgcatggcggcaaccgtctggcaagcaactcactgattgaagccgtggtttatgccgacgcggcagccaaacacgcactgagcgtactggaacgttatgacttcaacgaagacatccccgaatggaacgacgaaggtaccatctccaccgaagaacgtgtcctcatcacacaaagcatgaaggaagtaaaccagattatggaggcatacgtaggtattgtccgcagcaatacccggttgacacgtgcctggaaccgactggacatactttacgaggagacagaagcactcttcaagcgtagcaaggctacccgggagctgtgcgaactgcgcaacatgataaacgtaggatacctgataaccaagcaagccatggaacgcaaggaaagccgcggactgcactatacgatagactatccgcacgtcgggaagtaactaaagtaaaactcgcaccactatactggcacggaaaacgaacatggtcatttaaacaaagcgcccggatgctctgaagaaagcatccgggcgtttcccgttatccatacctgcacaagcaggagacattatcaatagtttgacttctttacttcgaagtaagcctgcggatgcaagcaagccggacatacctgaggagcttccttaccggtgtagatgaaaccacagttgcggcactgccataccacttcaccttccttggcaaatacgctggcagtctctatattctggataaaagcgcgataacgttcttcgtgtcccttttcggcaatggcgatgttacggtacataagagcaatttcggggaaaccttcttcgtctgcaatatcagcaaacttaggataatccaatgaccactcttcgtgttcgccggcagcagcttcctgaagattttccagggtagtgccaataacacctgcaggataagaagcggtgatttctaccataccgccttccaaccacttgaacatacgtttagcgtgttccttttcctggtcagccgtttctgtgaaaatagcggcgatttgttcgtaaccttctttcttggctacacttgcaaaataagtgtaacgcattcttgcttgtgattcaccagcgaatgaagtcagcagattcttctcagtctgagttcctttaacacttttagccatagtctctttttttattagttaatataattacgtataaatgtcgttcgtactgtttataaacaacacaaaattacgaatttagtttggaataatcacacctctgccccatcggatttatttatcgtcttatagaaagaatctatcttcaccgataacccgaagaggtatttcagacataattaatagcacatatctgataaggaaaacaaaatacatcacagttgtgttcactaatatccattattttatctacttttgcaggcaatttgcaatatatacattacattctgtataaaaaaacgtataaaaaagtagattataatgaaagcgttcggattcagaccaaagctatacacggctttaaaaaattactctaaagaactgtttatggcagacctgatggcaggtatcattgtaggtatcgttgccctcccgcttgccattgcattcggtatcgcctccggcgtatcaccggagaaaggtatcattacggctatcatagccggtttcatcatctccctgatgggtgggagcaaggtacagattggaggaccgaccggtgcgttcatcgtcattatctatggcatcatccagcaatacggtgaatcggggcttattgtcgccacactgatggcaggcgtactgctcatcctgctgggagtgttcaagctgggagctgtcattaagtttatcccctatcccatcatcgtaggttttacaagcggtattgccgtcaccatcttcaccacgcagattgccgacattttcgggctgacgttcggaggagagaaagttccgggagactttgtaggaaaatggatgatttatttccgacatttcgataccgtaaactggtggaacacgattgtaagtattgtcagcatcttcatcattgccattacaccgcggttctcgaagaagattccggggtcacttattgccatcatcgtggtgacagtggcagtctggctgatgaaagtatatggaggcattgattgtatcgataccatcggcgaccgtttcagcatccgtgccgaactgccggatgccgtgatgcctgccttggattgggaagcgataaagaacttgttccccgtagccattacaatcgctgtactgggtgccatcgaatctttgctgtctgccaccgtagctgatggtgtgataggcgacaaacacgattccaacacggaactgatagcacaaggtgctgccaacatggctaccccgctgtttggcggtatccctgccaccggagccatcgcgcgtaccatggcaaacatcaacaacggaggaaaaactcccgtagcaggtatggttcatgcagtggtgttgctgcttatcctactgtttctcatgccactggcacagtatataccaatggcctgcctggcgggtgtactggtcatagtatcctataacatgagcggttggcgtacgttcaaggcattattgaagaatcctaaatcggatgtcacggtactgctgattactttcttcctgaccgtcatcttcgacctgactattgccattgaagtaggtctggtgattgcctgcgtgctgtttatgcgccgcgtcatggagactaccgaaatatccgtcatcaaagatgaaatagacccgaatgcagaatcggacattgcaagcaatgacgagcacctgataatccccgaggatgtggaagtatacgaaataaacggtccttacttcttcggcatcgccaccaaattcgaagaaatcatggcgcggctgggcgaccgccccaaagtgcgcatcatccgcatgcgtaaagttccgttcatcgattctaccggtatccataacttgacaagcctttgtgagatgtcccaaaaggaaaaaataaccattgtgctctccggtgtcaatgaaaaggtacataaggtactggaaaaatcgggcttctatgagctgttgggcgaagaaaatatctgtccgaacataaatgtggcactggaaagggccaaaatgattatccaacactaatcccggcatggcacgaaaaaaaaagaaacaatcgcagggcgtctattatcttatattgtttatatgtgcagtctgccttgcctatgaacccgttgcaaagatactttcggatgccaggcaaaagaattctacgcctgccaagatagaactcacagcaggcacacgccttgaaataccggcaaagctgaagaacgtctccgaacagattctccagcggaaaggctacacagtatcctacaacaaggatttaaagatacccaattgggtagcctgggaactcactcccgaaaaactggtggagcgtgaaagccgtacagacaagttcttgcccgaccccgacctgcctgagcacgaggcagtaaccaccgatgactacaaaggagccggcatggaccgcggacatatgtgtccggccggtgacaaccgctggcactggaaagccatgcaagagagcttctacatgacaaacatttgcccgcagaaccacaatctaaaccgtggcgactggaaagaactggaagagtcatgccgccgttgggcacaagaagaaggcaagatatacattgtatgcggtcctattctctatgaccaacgtcaccgtaccattggtaagaagcacaaaattacagtgcccgaagcattcttcaaggtcgttctgtgtgcagacagcaatccccccaaagccatcggcttcatttataagaatgcatcaggcaatcatccattggacagctacgtcaatacagtggacgaagtggaacgtattacaggtatcgacttcttccccgcccttccggatgaaatagaagagaaggtggaagccgaatatgacttgaaactgtggtaaaggagctattcctttacccaggcatctacaatctcggctacataaacccggtgcaatccaccgtggtcaccgccataccaacgctcgtagacggaatggtcgagaaagagttcttctttcatatcggtaatgaaaagcttgcggcactccaatcccaggcggtcctgctcaaagagaatgtttccccgctcggtaacgataggattcagaccagtttcctttaccttatccacttccctacccgatttactgccacaaaggttgtaaatgctccgattttcctttcctaaaaaagaaagagtgaaatattcgttctcctccataaactcatacgtatagcgctcggaacgaataaagacaaacaccaccggcttgttccaaagccagccaatacctccccaactggcagtcatggtgttgaaatgttctttactgcctgccgtaaccagcatccactctttgcctatcacttcgaagaagttctcgcttaaatctttaattgctattgatttcataagtatattattaataagaaacacttaccggtatacccgtttcccgtatccgttccgcaatgcgatccagttcctcgcgggtggccttctgcaaatcatggtcgggcgtttcgcggtcgatggtataaatcatcacttggcggggagcaatctccttgacagcttccagccagggaagaacaaatttatcggatgtattatccatatcttgtcctttataacttcctttgagaaacatggtctggataatgcagttccctttgaacgctttcatcccttctataatctcccggatggagtaatgtccggtaggacggtcaagtacacggatatactcttcatctaccgtatccagtttaaggatgttgttgtcaatcttgttcaaagcctcgaatacggcaggacgatgaataaaggtagaattgctcagtacgctcacctttgcattcggaaaatacttgtcgcgcaaggcaagtgtatcttctatgatttcggggaaacggggatgtgccgtcggttctccattaccggcaaaagtcagtacatccggtgtaggtccgttttgctgcatgtcccgcagacgggcttcaagggccgaacggacttcttcgcgcgtaggcaacggctgtttgggacgatggtcggcattgaagccacattcacagtaaatgcagtcgaaagtgcatactttgccgtctgccggcaataaatttattcccaaagatactcccagacggcgagaatgaacgggaccgaatatgggagatggataaatgacagtcatactatttatgatttgacgatttacggtttgattaatgcttaaacaatcttaccgctccaaagttaagtgaaaactatggtatctggcaatgttcggcttgcaaaagtttacccataaaagaaaatattccctttataaagcatacatttcatgttaaaaaagtaaatcatacattacattttatctattttacttgtttatatgtaaagtatacattacatttgcagataacatctaaatgcatagtattatgagaaagaactatttatttccaaccactttcagaaagataggttggtgtttatttgtcccattcgccatcacgtccttcatctgccttttcgacggcagcaatgaagattggttgaaggtaaacgcgttgtcagtaattccctggggtattatcaagaactctttattcgacgagttgagtatgatagggcttacggtttcactcttgttcatagctttctcaaaagaaaaggacgaagatgaatgcattgccaatattcgttcaaactctcttatctgggctaccataacagcgtattccctactgatagtatgcactatgctgatttatgacatgcaatatcttaattttgtatttatagacttgttcatgatattgtttctgttcatcataaagtacaacattgaactttataaatttaggaggagcaacaatgactaatacattaagggtagaaagagccatcaagcatatgacccaacagcaattggctgaagccataggagtgagccggcaaaccatcaatgccatagaatcgggaaagtatgtcccttccaccttgctgtcattgaaaatatcagagatattcggaaagactgtaaatgaaattttcatgttggaagaaagtgacagataaagagaagactctaaaaaactgttttaattttatttcagttttcttctgaggcaacctgaaaaataaaattaaaacagtttctaaaacttgatacgcagttgcatctgcaagtccgctttcctatttcccggtatctcatcattgcccgaaccaatcgtctccctatcctgataaaccgtctgtccgaatttggcaagaaacatgaagttcttactcaaatcatatcgcagatgagcggagtaacggaaccctttgccatagaaggaaggggtatagaaagtatataacaatccacgctcggaggcgtaaacacgcgaatcgtaatcgtccgtatgaaaccaggttccctgcacggaaactgacagagggaaggggaaagtgtacgagcaaaattgagtacactgataaccttgccgtctatcaaagcgatacccttccccatcctgctgacggaagtggttataatctattgtagtacgaaagatatatcttcccggcatataggtcagccgataacggagtttatggtgatagataggttcgataactgcaccgcttgtacccgtcacgtctctttctttctgtttgtaccgataattaaaatacatcgaaaggctctttcgaggagtataagtaacctgaaacatggcatccactccctttgagggcttacttatacggtatttccaccaaggaaaagaaaacacatccagtgaagtgaaaaacttccaatgagcgaaaggtgtggcctctgctgccaaataccatccattctcattctgcggcatactgctttcgccaaaggaacgcccaaacaaagtccaataatcatatgaataataccggtgaacaagtagcagatgataatcggaagaaagattatacttcagccggttcagcaacgcatagcctttactgccggttgccgcttcccccacccagacaaaacggcccagacgatacctataatccatacccacgttatagaaatcacttccatgaagattatactttgcatacttgttcaaccgaggcttgtaaggacggttgaaaaaatagtaaatccccgttactcccaccttcagagagttcttttcataggtcatgtttccacctattacctgcaaggcaaaggcattcattttatctgcctccttctgcgtgcgatgcaaccctgtcttgtaaatggaagttatctcgccatcctccaccacaccgtccatggagcgatgcgaatagaaagccgaaatatccaagtaaggcaatactcccaccgttgccgccactccccggaaataattgtactcatcagtagaactatgcttacggatgcctccggtacgatattctgttgtagacatagagaatgtttttcctaaacgaaaatccgtactaagtaccagtccctgcccgaagctcagacggtaattgcccaatgccaaagccttcagccgccccagattctttatcagaaaatagaaagaatagtaatcatagccttttctgttgtgcagggcaaagaatggttctccggcatccttctctcccgtcacgcctatttggagataatctccataatgaaaattatagcgcaaagaatggtaaagggaaggtcccaggtaattcttctcatatcctttacggatatagaacggtacatccaaacgtgccaatgtttcgtgtttcccgtatttcagtatagattttaaagcaggataccccctacccgctttcactgcccgcacacagacaaagggcagcagtaggtcgatggtacgtttatccatctcctccaccagttgcaattcataaatggtctgcatctgtccgtatatatagacataagccagaagattctctatctgtatatccgtaagaaaaggaaactgctccaattgctgtttagtggcggcattgaggttgacaggctcttgcagacgtcgggacaactcctccaattcatcttcccaaccgtattcttcctcattcccgatggaaagttgttccaaattttcttccaaaagaagtaaaggctgttctttctgaaggccggatatattttgagcttcaagcataggagtcattgacagcatacttacaaaaactcctatcttgagtaattccattaatagtaggtcactttcatgttttgggaagcgaagttaccttaaataagttaattgagcaaggaaaaatcaacatgatgcaacaacattacacagaatggtgtacttttgcaacatgaacgcaaggcttaacatagtaatactcatcatgtttctttctctcggaagcctgaaatgttttgcacagcagcaaccacagtctgctgcgcaaaagagtgtctatcttactcccatgtgcgtttacgaaggagataccatcccttatgtcaagctccccactgtctacatcttcaagccgcttaaattcaagaacaagcgcgacatgaacaagtactacaaactcattcgtgacgtaaagaaggtacttcccatctccaaggagattaaccgtgccatcattgaaacctacgaatacatgatgaccctgcccaccgagaaagcccgccagaaacacatgaaagcagtagagaaaagcttgaaggagcaatacactccccgcatgaagaaacttacctttgcccaaggcaaactgttaataaaactggtagaccgacagaccaactccaccggatatgaactggtaaaagcttttatgggccctttcaaagccggtttctaccagacttttgccgcactcttcggcgccagtctaaagaagcaatacgaccctatgggagacgatgcattgaccgaacgggtgatattgatggtggaaagcggacaattataaactgatgtttattcccgccttgcgtgcctgcaaatgttgaaactggcgtttcacatcatatgtctttccgtctttgacgaacttagagccggtctgcttgaaccagaactccactttattttccacacaaattctgcgaaggtccatcacccattcaaaatcacaagggcgggcttcgtaaccggattctccccctgcaactatctgttcaatccattcgccaacagcataagtacttaaatctatcctttccagcagcggttcacagattattatcttatgctttatgggagccatcctatagatgggcaagcgataatcggcgcaagtctggttttcaaccgtacaacagatggttacattatcatatccgtctccccaatcatcgggcagacagtcagaaaaacggtctatacgcttggtaatcatcataaaatgcagatcactgcggtaacgaatcatctcccatgcttcggcccgccatttgtcagcatcttccacaaagaaatcggaagtaaagcaggtgtagacaaatgttccaggtggtatcttgaattctccgttacgctttttacgcaaaggcaggtcaaagttttttgtccgcaccaccaccgaactgtccacctctcgccgagcatcaccacgataaacataacaatacttacaacctgcactcaatttatggcaaccatgccataagttccacatcatcgacttcgcaacaataccgttcattcaaacaaaaaacttatagttaacaccatgttgaaaactatgttagcaacacaaataattagttattaaacaattgatattaagctatatattcagttaataacagaatgaacaattgtttattactacttattcgggttgtacctctcctgccatcggaagctctttccaaccttcaccaaatgcatcataagcatcggtaaccactacaaaagcctttgggtctacttcccttatcttctgcttgatacctaccacttccttgtaactcaccacaagaaacagcatttccttgtctacattggtataaagaccactactcttgatgcaagtggctgtacggtccaaatctttaagaatatagtcgtgcaaagcggtaaggcgcatatcactgatgacaaacagtatcttgtcattcttctccccatttatcacataggccaataccctcgaagtgacaaaaatagctatcagtgaatagaaagacaaatgccacgaaggttgtgtagcatcatccggatttccaataccgaaaccgataaccaataggccgaatcccaccacgatgccatctaccagcagtatcgcctttgaaaaacgtatatggcaatatttctgcaatatcatcgccacaatatccgtacctcctgtagtagcccggctacgcactacaataccacagcctataccgataactaccgcaccaatcacagaagtcagcatcaaatggtcggacatattcagactgccacccagcaactgtgtagggtccaactgatggagcgcttcttcagaaggataggagaggagagacagcacattcatggcaagcggagtgaatagtgccgccacgatagtacgtgctcccaattttgctcccagtaccagcacggaaatgataagcaaaggaatatcaaacatataaccgaaagtacctacttgaatagaagggaacagattatgaagcacaatactggctccatacaccccgccaggaacaagattataaggattgataaagtaaacaaaacctgctgccagaatagtacaacctacaaaaatgcctatccatgaagatattatctttttcatatcgatatgatttatatatattcagcaaatatacaaaaaataagaaaagacaccaactgtacagcaagttttccacatacaaccgatatgtgttgaatacatggttaacaaaaaggatagattaggagataaagcattaatttacaatgaataaagtggttgatttttataatcaaccactgttcataaaatctctcatcatacctatatagctccaacaaacccgatatattgacagcttattaacagccctgttattatctcagtttcttgaataaatcccaaataacaatacccgccgtaaccgatacattcaacgaatgctttgtgccgtattgaggaatttcaatgcaaccgtgcgaatggtcaatcacttcttgttgaacacccttcacttcatttcccattaccacagcatactttttagtcttgtccagcaccagttcgtccagcatcacactaccttccgcctgctctacagaataaacaatgtatccctcggcttttaggttatcaacagcttcaacagagttatcaacatatttccaatctacggtaaattccgctcccaaagctgttttgtgcatctccggatggggtgggatagctgtaatgccacaaagataaatgcactcgatgcggaaagcatccgaagtacggaaaacggaacctatattatggagactgcggatattatccaataccactaccaaaggcagtttttcggcttccttaaattcctctacactaatacgattcagttcagttatcttcagtttacgcatgacaatatacttttaaatctccccgcaaagatacttttttccgtttatatcccggttaataaccgttgaaaaggtgtcaatacaatagggaaacaattttaaaaataatccttgcattattcaaaggtctgcatattacagcagtgaaacgaacaaaccaaaaaagttaaggagaattttccaggcttcattcaacatatttttcagcctggtttcatcggtttataactctaaagttattaactttgcatattattaacaacatgttaatgctgtttagcagaagtcttattatcaacggataaacttaaaaaccccggtttataagcataagagtaaaattcagcttgatactaataacttcataggcaagaaaaatcgtatttatttgtccacactgttaacagcctatcattactatcaaaggatttttaaagaagaaagagaaattaaaaaatataattatggataatcttatagaagctatcaagcagctgaagaaggagaagaacgcaatcattctgggacactactaccagaaaggtgaaatacaagatatagccgattacgtgggcgacagtctggctttggcgcaatgggcggcccggacggaggcagacatcatcgtgatgtgcggtgtgcacttcatgggagaaacggcgaaggtactttgtcccgacaagaaggtactggtgcccgatatggcagcaggctgttcgttggcagacagttgtccggcagacaaattcagtcagtttgtcaaagagcatcccggatatacggtgatatcctatgtgaacacaacggctgccgtaaaggcggtgaccgatgtggtggtaacttctaccaatgcaaagcagattgtggaaagcttccccaaagatgagaaaataatctttggcccagaccggaacttgggtaattatatcaactccattaccggaagaaatatgttattatgggatggcgcatgccatgtacacgaggaattctcggttgaaaagattgttgaaataaaacggcagcatcccgatgcggtggtactggcacatcccgaatgcaagagtacagtcttgaaactggccgatgtggtaggctctacggcagctttgctgaagtatgcagtggcacatcccgaaaagagctacattgtagctaccgaaagcggtatcctgcacgagatgcagaaacaatgcccgcagacaacatttattccggctcctcccaacgacagcacttgtgcctgcaatgaatgcagttacatgcggctgaatacactggaaaagctttatgattgtttgaaaaatgaatcaccggaaataaaggtggatgctgagattgcagaaaaagcagtgaaaccgattaagaggatgttggaaatatcggctcaactggggttataatgtgctgatatgctaatgtgccaatgtgctaatgaccttttggcgtgacagcgcagctaattagcacattggcacattagcatatcagcacattaaaaacattatctcattaaaaacttacacaacttgttagtggccaatgcccggtgactgattttattcttcagttcattccccatttctgcaaaagtctgcgtatatccttcgggaatgaatatgggatcgtaaccgaaacctgaagtaccttttctgttttttgtgatttctcctttcacgatgccctcaaacagatgttcctttccgtcgatgataagtacaaatacggtacggaattgtgccttacggttctcgatgccctccatatctttcagcaacttcttcatgtttgcttccgaattgtgtgcatcgccggcataacgggcggaatatacacccggtgccccaccaagggcctccacttccaaaccggtatcgtcggcaaaacagtccagatgatagttatcgaagatatattttgctttcagcaaagcatttccttcaagtgtgtctgcagtttccggaatgtcagtatcgcatttgatatccttcatgctgagaagttcgaccttttctcccaaaatggcagtcacttcttccagtttgtgtgaattgttggtggcaaatacaaatttctttctcatattatgttctccttatacttgtggcttatacaagtccctatttcactttcaaccggtcgaaaccttctccgtatacaccgatgacggaactttgggaaatgaaagcgttcgggtctatatctttcaccatccggaatatttctaccgattggcgtttgtaggcaagtacgaccagtaccttcacgttgtgtttactgtaccagccgataccgtcgagtaccgttacaccgcgatgggtttctttggtgatgcgatcggcaatcctttcatattctttggagaaaataaagaattgaacagattgccgggtgctattgacaatgtaatccagtacaaacccgatgacaaacaaagttacaaaaccaaatatcacacgtctccagtcatgaaataccacgtagcaggaactgatgatgatgaagtcacaggccattatcatgcgtcccagtgtgacatccttgtatttgtggatgatggctgcaataatatccgtacctcccgtgctaccgttgcagttgaatacgatgcccaggccggcaccgcacattgcagcacctatcagacaagccatgaagtcttgtccttcgcccagcagttggggagggacaccatcgggaccattcaccaacagctggaaaaaccatagaaaaaaggtcagtccgaagatggcaaacgtggtcttgatactgaacttcggtccgagtatcttgatggcaaaagtcatcagtacggcattgatgatgaagtatgaccactggatgggaaatccagtggcataatagatgatggcaccaataccggtagtacctccggtcgtaatctggtaagggatgaggaaagctgcccatcccaatgcatagctgatgagccccaaagtgatgaagatataatccttcagttccctcgtcacttccgctttggttggttttgtaatttgcatatctgttatttaacaacgatgttcacaatcttctttggtactacgattactttggcaatggtcttgccttctatccatttttcagagcgttcttcggccaatacagcagtctggatggcatccgatgccgcatctgcggggaattccatgttgaaccgtgcctttccattgaaggaaatggtgtagttgaccgtatcttccaccaggtattcttcgttgcatactggccacttggcatcgcatacagaacctgcattgtccagagtctcccacaattcttcgcatacatgcggagcaaagggagccagaacgatgatgaactggttcagaatttccttcttgctgcatttcatcccgaacaactcgtttacacaaatcatgaaagcactgatacttgtgttgtaagagaattgctcaatgtctcccgtcactttcttaatcagtttgtggagggatttcagttcttccttggtggcaggttcatctgttaccagataattgtcgttgcggtcgtagaacagtgaccagaacttcttgatgaagcggtgtacaccgtctattccgtttgtatcccatggctttgattgttctaccgggccgaggaacatttcgtacatgcggagagtgtcggcaccgtatttgtcgacaatcatatcgggattgacaacgttgaacatggacttactcatcttttccacagcccatccacagatgtacttgccgtcttccagaataaactcggcagttgcgtattcgggacgccatgctttgaaagcttcaaggtccagaacatcattggatacgatattcacatcgacgtggagtggggtagtatcgtactggtctttcagatttagggacacgaatgtattggtatctttgatgcgatagacaaaattgcttcgtccttgaatcatgccctgattcaccaacttttggaacggttcttcggctacggagatgccgaggtcgtataggaatttgttccagaaacgggagtatatcaagtgaccagttgcatgttcggtaccgcctacgtaaaggtctacattgtgccagtattcatctactttcttatccacaagtgcctggttgttgtgtgggtccatgtagcgcagataataggcgcttgaaccggcaaatccgggcatagtattgagttccagtgggaagacggtggtgttgtctatcttttcgttttccacaacacatttgttcacaatatcccaagcccattttgtggcatgtcccaatggaggttcaccggtttcggtaggcaggaatttggcaacttcgggtaattccaggggtagggcactttcatcaatcatataaggcatgttatccttgtagtaaaccgggaacggctcgccccaatagcgctgacgtgagaaaatggcatcacgcagacggaagttcacctttacacgtcccagattgtgctctttcacatatttcttggtagcagcaatcgcttctttgatggtcagtccgttcaatgaaaggtcacaatagggagtaacaccttctcgtggagagttgcatacaataccttccttggcatcgaagctttcttcgcttacatcgcaaccttctaccagcgggcggatttcgaggccgaagtgcttggcaaaagcatagtcacggctgtcgtgtgcaggcacagccatgatggcacccgtaccatatccggcaagcacatagtcgcttatccagatgggtactgcctcaccggtaaaggggttgagggcatagcttccggagaatacaccggtaacgctacggtcggtaatacgttcgcgttcagtacgttttttggtgcgttccagataagcgtttacttcatctttttgtatgtcggtggtaagttgtggtaccagttcgctttcgggagccaataccatgaaggtgacaccgaacatggtatctgcacgggtagtgaaaatagtgaattccaaatcactgtctttcactttgaattgtatctccgcaccttcactgcgtcctatccagtttttttgggtttctttcaaggattcggtccaatcaatggtatcgagtccatccaataagcgttgtgcataggcagatacacggagacaccattggcgcattttcttctggatgacagggaaaccgccgcgttcactgacaccgtctattacttcgtcattggcaagtacggtaccaagttgcggacaccagttaaccattgtttcgcctagataggcaatacggtagttcatcaggatttcctgctgttctttttcactcttggcattccattctgtggcggtaaaactcaattcctcgccacaagccacattcattccttcagtaccggtttggctgaatgcttcaatcagttcctggataggacgtgcctgctttttatcgttgcagtagtaactgttgaacattttgaggaacgcccattgggtccaatggtaatattccggttcgcaggtacgaatttcgcggttccaatcgaaagagaaacctatcttatctaactgttcacggtatcggttgatattgttgacggtcgtaattgcagggtgctgtcccgtttgtatggcatattgctctgctggaagaccgtaagcgtcatatcccatgggattcagtacattgaaaccttgcagtcgtttgtagcgggcgtaaatatccgaagcgatatatcccagcggatgacctacgtgcaatcccgcaccggaggggtaggggaacatgttcagcacatagaatttctttttcgtttcgtcttccgttacttggtaggttttgttttccacccaccttttctgccatttcttttcaatctccctgaaattgtattccatagtggtatttattaatattttgttgaaaacattgtttattccatggttaaaaccggttagtatccggttaatatcggtgcaaagttacgggtttattttcagatttgtagctaagtaacataaaaaacaatggcaaaggcttgataattcactttttattacttacatttgtgatgtgcttttaaaactaattttttgtttgtaatacaaataatagctaaattaattcaataggatatttactaaaagatttttaggatatagcgaaggatgaagtctgggaagatttcatccttcgcgttattgtgttgaagaagaaagtcgtatctttgcgcaacttatcggaagtgtatgaacgcaatgaaaaattatacttatcatattgtcgccgtccttacggtaggtatttggggtctgacttttatttcaacgaaagtattgattgggcatagcctttccccgcaggaaatattcttgcttcgtttcctgatagcttatctgggcatctggtttatttctccccgaaaactgtttgctgataattggaaagatgaatcttggctgtttttaggaggtatagcaggcggttcattttacttttttacggaaaatacagctttggagattacattggcgacgaatgtggcatttattgtctgtacggcaccattgctcacgaccattctttctttgtggatttataaaaaggaaaaggctacccgtggattgatggctggttctttgctggcgttggttggtgtggcattggtggtttataatggtagttttgtattaaagatttctcctttaggtgatttccttactttacttgcagctttttcctgggcattctatagtttaataatgagaaaaatgtccaactgttacagtataatttttattacccgtaagatatttttttatggggtattgactattcttcctgcatttctgattcatccctggaacttcgacattgtccgtcttctcgagccggctattttgttcaatttacttttcctgggtgtattggcttctttgatttgttttgtagtctggaacgtagtcttaaaacagctgggaacgataagagcttccaactatatttatctgaatcctctcttcactctggtaggttctgcttttctgcttggcgaacagcttactatagttgctttgatgggggcggtgctgatattgggaggagtatattgggcggaaaaaaagtaaaattctccttttctatgataaaattctatctttgtcttcaaaataataggcaagacgaaacttctttcggaagacgagtcggtaaccattaaaacagtgaaaggagtagggttgatattgatagaaaattaataatgtattcttctatattgtaataatttagcagtatatgtactgctcttctgatttattttcgttatttttgtatagcagtattatgaatataaataaggagggtatatgtgtataaaacggaaagtcaatatttcttgtcttgatgtccgtttgggaatctgcctgctgttggcttttgtgccgcagttgctttttgcgcaggaagacagtgtacgtttcattcgtgacagtatacagatacagccagaattcaatgaatctctattctctccttttgagcttccctctggaaactttgccccttcttctatgtttcatccggaacactcctattctctgcccgatttttcactgaaagagtctcttcgtctgccttatcagaccaatccttctctgctatttcggggagattacagcgcaagtggtgtattaagacagttccctcacggtatgttattcggttctggtgggcagaccagcgtaccgggtatcggacgtttcaacaatgcttccctgggatatcagcacgcctttaaccaaaggctgacgcttcagcttggcgtagatgccatgaagataaatatgattcattccaccgggcaggctttcagtacttcgggagttttgcggtatcaggcttcggaccgtgtaacttttaaagttttcggttcgtatgccataggaaatccttatgggatggatacccaccattatggtgccaccatatcgctagatatgtccgaacgttttgggatggaagtcggggtacaacgttattacgatgcttatcgcggtcgttgggagacggtgcccgtggtgattccttattataaattagacaagtttaaattaagtctggacatgggcggaattttgtatgagattctgcgtaatgtcgtttttcctgataaaatgaactccggtgggccgacacttgccccaccacgttttcagatgccaccgttacgataaagcaagtatcaatccacttatttctccagcaccggggaaccctgccttccccggtgccggagaaatgggcagagttttttgaatgaaagaaccgtggtattacgaagacttttcctcctttttattagccttttccagagattctcattaaatttgtgctcaaactcaaataattcgacgacgaaacgttacaccatcactaccttacttgtggcactgtggtgtatcagcttgtgtgcccgtacccaaaaagcagtctatatcgtcatagacggagttcctgccgaccagatagagcgcttgcacacacccgctgtcttcgacatcgcttcaagaggcgcatatgcccgggcatataccggtggagaaataggcacttactcgcaaacgcccattatatcggccatcggttacaccaatctgctgacagccacctggctgaacaagcataatgtgggaggcaatgacaacctacagcccaattacaactattggaccattttccgcatcgccaaggagcagtcgcgtccggtgaagaccggactctactcgagctggatcgacaaccgtactgtgctcataggagagagcaaggaggagacaggccgcttgaagatagactacgtcagtgacggttacgatctcgataaagtccgctttccgcacaaggagaaggatttgcatgtattcgactacgacgaacaagtatccaaggatgctgccgagagcatccgccgggatgcacccgacctcagttggttttatctgtggtacaccgatgatgcaggccatatagagggcaacggcgaattcttcgatgcgtatgtgcgcaaagccgacgagcaggtggcacgcgtatgggaaattgtgaagtatcgcgaagagcatttcgatgaagagtggatggtagtggtcaccaccgaccacggtcgcactgaaaacggctacggacatgggagccagtccgagcgcgagcacaccacctggatttcgaccaacgtgccggtcaatgcgcatttcgcagaccgtaatctggccataaccgacatagctccgtctctcagccgctaccttggtttcgaggtgccttcggatgtcctttgggagcaggatggcattcctttcatcggtcggacagacatctgcgacttgaagaccatgccttatgacgacaccgtgaccttgtcatggcgcacttacgcggagtaagtgccggtcaccgtctacgctgctacgactaatcatttcaagaccggaagcaaggacaattacatcgagcttgccaagttgcccgccggcaccacttcctatacggtaaatctgaaagaacttccccactcgaaattctataaattcgtagtagttgctcctcataatcatttgaatcgttggttcatgaaatagagaaatacccctgctacaaatagctgtagcaggagtaaattccataaagagagagttctgatacatactcgaacttttctagttggaggtattatgacatccttaatgtatatcttttatccatggacctctgtccgtgccagttccacaaatctttttctgagttcttccgtatagaaccgtgtatctcccgattccaagtgcccgttcgtgttccaaagctggaagaagtaggcatcatggcattggacgatgtgatcgtgctggatggtgaagtgctctccctcctgctgcaagggtagtctgcccaatagggagttgtatagtgactttgttgtccgcatatcgtccgtttctttgtcatatagggtgaaatactcgttttccgcatcttcgaattgcatcaacagataccttttcgactgctggatacggtctatccctgtcacataattatcctggaagacggtttgtagggcagtggttccgtcaccatcgatatactgctggggcagtcaccggtttccgaaatctaccttgtaccgtagggagatgctgtcgtctttcagcttgtacacttcgtcgtaaggatagaaccacaacagcgcttcttcatcagtaggtatccaggctccattcccgttgccgtcgtccgcctcctcttagaagggaagatgcttttccagcttgtcaccctccttcaggtccagtgcgaacagatgataacagccttcgtgtgtccggttgctgttgggcagatagagcttgtcgcctatgcagaacaaatcttccgtccatataccgtcggctggtttttcgcgcaggaaccgcccttctgcatcgaagaagaaaaacttgcccaggaaatggtcgaatatcaccatttccgtcccatgtacggcgaagcaggagatatgggtgtactcgcccggtccgttgcccacccggtggatgtcggcttgcagcttgctggtggtgtcgaacacgaacacgcgcttgccaagattgtccgctatataaatcaggtcgttctgatagattagtttcgtgacttcgccaatcaggcactcattcgttgcttcgagctgaaacatcaggatgctgtcttccaccatcggcgcataatccagcttgtcgctgatgtgtttccagtctatttgcagcacctggatgcctgtatttgcgggctttatcccgccgctgtgcgtgcacccggcgaggacaagagccaacagatagaaaatgtatttttttatgtagcaaaataatggttgattatacttattcctcggatacggattcgccggaaccatacttcattgtcttcccctctttcgacaaggaaggcggcactgctcctttcgatactccccggcgataattgggtttgctgctcatcacgaaccgcagcttcactccgttgcggatatcctcatacgtcaggtaggatttgtcatgcttcttgccgtttacgtacagctctttcacatatacattccgtggagaccagttgtcggcctgcatctctatcagcttgccgttgctcatcttcacgctggcggcctccaggcaaggcgagccgatgttgtagacattgcttgagggcgctaccggatagaatcccagacagttgaacaaataccatgccgacatttgtccgcagtcgtcattcccgctcagcgcatcgggtgtgttgccatagaagcggtctacgatggcacgcacccactgctggcatttccaaggctctcttaagtaattgtagagataagccacatggtgacaaggctcgttgccgtgccagtaagctccgatacggccttgaatgtcgtgtgctccgggaatatcctcaggcaactccacggtgaacagctcgtcgaggcgcttcttgaacaactcctttcctgccagattgatgtacccttgcacgtcttggggtacataccaagtgtattgcactgtgaatccttccgtgatatcgccccagccgtgcaccgagccgggaccttgataggctacgggagtgaacggtgtgcgccactggccccggctgtcgcgtccgcgcatgtatttggtctcggggtcaatcagtgtctggtaggagagggcacggttcaggaagtagcgataatcctcttccttgcccagcttgcgggctgcctgtgcgatgcaatagtcgtcgtaggcatactccaaggtcttcgataccgattctgcctccttgtcgaagggtacatagcccagttcgcgatactccggtagacagtcgtagtggggattcatcgccgtagtcttcatggcttcgtaggcgcgctcgtagttgaagcccggcacttccttcacaatcatgtccgccagcaccgatacggcgtgatagcctatcatgcaccacgtctcgttgccgtagaacgaccagacgggcagcatccgctccacgcttttgtcatagtgtgccagcatggagttggcaatgtcggcgttcacgtcctgatgcaccaggttgaaccagggatgcagggcgcggtacgtatcccacagcgagaagacggtatagttcgtaaatccttcggccttctcgatgttcttgtccagcccgcgaaagctgccgtcggcatcctggaagatgaacgggtgcagggcggcgtggtaggccgaggtatagaacgtttccttggtcttgcggtcggcagtgagggtatatttgctcagttcctcttcccacaactcttcgccccgggttttcagggcattgaaggtcaggccgtccagttcgcggaggttgcgtgcggctccgtcggtgctgacggcagagatggcggtcttcacggtcacttcctctccctctcgggtggcgaaggagatgcaggccaccaggttcttgccccatgcctcgcggtcgctgcggaagcgcgaggtgttgtagattaccggttttccatcctgcatgatgcgcagtccgtccagtttcttcgagaaggtggcggtgaagtagacatggcgttcggggccccagcctttcaccagcttgtagccggtcagtgtggagtcgttcaccatgcgcagattggcccattcgcacgactgccacagcgtatggttcaagtcgatgaggataaacgctttctccgctttgggataggtgaagcggaacatgccgctacgcaggcccgaggtcatttcggccttcaccccgtagtcgtccaagtgtacggtgtagtaattgggcgtggcctgttcgcgttcgtgcgagtagcgcgagcggtagccttcgtcgggattctcgggtgtgccgggagtgagcttcgcctcgcccgtgccgggcatgaagagaaagtcgcccaggtcggggatgcccgtaccgctcaggtgggtcagactgaagcccatcagcgaggtgtggttatacttatagcccgaggccgcatcgtagaagcggtggttcgtgtccgggcttatctggatacctccgaagggaatctgggcaccgggatagacgttgccgtagccgtcggtacccacgaaaggattcacgtaatcgatgagcttctcagattgggcgatgcccggcgcggagagcgccaggcatgccagtgtgaatcctaaaaactgttttttacctttcttgtccattgttcatagtctgtttgtatgtgttatgcttcgatgtctcctatggccacctggtactcatgccacaggtcgtcaatattgtatttttcgcccaagacgtgcttgatggcaccgtcgaacgaccagggcaccacctcgagcgtgctgcggttgaacttgcgcaggaactcggggtccttgttgtcgcgcagccatacgaagaagtagcccgctttccggtaaccgtccatgtagttgccgcctttggggcgtccatcaggaccaaagccgccgttggccacgcgcacagcatcggccatgccctcgatgaatgcccagaccacgcggttggtaccatacgagccgatgccttgcggttccagctggtaggcgtgggtcagttcgtgcagcagcacgccgcgggtctcgaagaagagttttgcggtatcggcttcggcaaatgatttttcgatgtggcgcgtgctgtagaagatggtcacgtcaccgttactgcctcccttggcggagatgccgtcgatgtcttccagcgtatagtggatgttgtgcaccggtgcgatgctgtcttcgggcgaggcatagagcgtggccagcacggtgcgtgcctgttccttgatgtacgattcggcatcgggaatgatgcggtgatagatgtccgaaccggccgattcgggtgctttgtcttcgaagaggatagtgccgacgttgtaatcgttccagtcggtcggtttggctgcagtttgtgtatgttgctggcacgcgtaggtgccgaaggcggctgccaggcaggcagtgtagagcagatttcttgttttcatatcttttgagtttttaagttgtcggttgaagtttcgcaagttcttatactgttgataagcagtggcttctcaattctcctcctttccgtccgtcagtgagtaaggcttcgcgttggtggcggtgcctcggcgcttgttgggcgaagcggccatcttgaattcccatacgccaccctccaataggtcgctgtggctgatgtacatgttgccgtattccttgccgttgatgcgcagcgactgcacgtagcgcttcttgtcacttacaccgggtgctttgatttccagtgtcttgccgttgggaagttctagtttcaggtagggcaggtagggagcgcccagcacatattgattcgtacccgggcatacgggatagaatcccatcaccgagaagagataccaggccgacatctgcccgcagtcatcgttgccgcccaagccgttgatgtcgttccgatacatcttgtttaggatttcgcgcagccagtactgcgtcttccagggttgcgaggtccaggcgtagaggtagggcacgtggtggctcggctcgttgccgtggacgtagccgcctacaaggcattcggcagtgatgtcttcattgtgctcatagtacttctcgggcaggtgcatggcgaagagtttgtccagcttctccatgaactgcttttcacctcccatcacttgcatcagtcccagcacgtcgtggggcacgtggaaggagaagttccaggagtttccttcgatgaagccttcgccgtaggtttgcaatacgtcgaactcctgcttgaaggagccgtctgccaggcgcgggcgggcgaagccgatggaaggatcgtacaggttgcggtagttgagggcgcgcttgcgatacacgtccgccagttcgcggtggcctgctttcagggctgcccggtagatggtgaagtcatcgtaggcatactccagcgtactggaggcagccgtaccgctcttttccaaggggatgtagcccagttttatgtagtcggccaccccttcatagtagggcacggtagaggtactgaccatcgccttgagggcttcgtcggtttcgcctttcaagacgtcctttaccaaggcgtccgatacggccgacactccgtgatagccgctcatgcaccagttctcgttgcccatcaggctccacacgggcaacatgccgtgtacactctgccgggcgtgggcaatcatcgacttcaccatgtccgcattgcggtcgggcttcaccaggttgaggaagggatgcagggcgcggtacgtgtcccaaagggagaagatggtatagttggtgaatctgtcggcacggtggatgttgtggtcgagtccgcggtactggccgtccacgtccatgtagaccgaaggattaatcatggtgtggtagagcgaggtatagaacatcgctttctgatctgctgtgccttccacggtgaagtggcgcagttcgcggttccagctttcgcgggcttcgtcggccagctgttcgaagctcttgccggcggcttcggcgcgcaggttcttcagggcgccttcggtgctgacagcagagagggccactttgactacgagctcgctgttctgccgggtgtcgaaatggaagtaggagacgattttcctgccggtgatttcggggaagttcttctccagcttgaagcggcgccagaagccgttgtacttcacgggttccaagtcacggtagccgtagtctcgtatgggctgcgagagggagatggcgaagtaggtgtaattggtgcgcgcccatccgttggtaatgcggtagccagtcagcagggtgtcgttctccacgcgcaggttggcccagagcactttgccgttgtagttgtagatgccgtgcgttaggtccagtacgaggtgcccggcttcgccccaagggaaggtgtatttgtgtatgcctacccgttgcgtggcggtgagctggacacgtatgccatggtcggccaaggtcacttcgtagtatccgggcgtagacttctcggtggcgtggtcgtagcgcgagcggtagccctcgttgggagtggcggcacgtccgggagtgagtttcgggctgccggtggcgggcatcagcaggatgtcgcccaggtcggagtggcccgtgccgctcaggtgcgtgtggctgaagccgacgatggtggagtcgctgtactgatagccggcacaatactcgtaggccttgccctgataccgtccgtccacgttgtgcgggatggtatcggtgtccgggctgagctgtatcagcccgaagggagtgcaggccccggggaaggtgtgtcccatgccattggtgccgatgatggggttgacatagtcggcaggctgctgggccgctacttgcagggtcgcggctgtcagcaggatgatgaatgttttaatcttcatgatgatgtggttaagaatgtttttgtcatttatgacttgttactcattgctgagtgaatacggaaaatcgctctccttcacgccgcgcgtcttgttcggacggctgtccatgttgaaggtcagcttgccaccgcgcagcaactcgaagtggtcgaggtagtttttggtatagttcttcccgttgtagttgagggaacggatatagcggttttcatcactgtttttcggggcggagatttcaagttttttgccgttttccagttgcagcgtcaccttcttgaagtagggggcaccgagcacgtactggtcgcttccggggcagacggggtagaatcccagtgcggtgaacacataccaggccgaggtctgtccgttgtcctcgtcgccgcagtagccgtccggtgtgggcaggtagaggcggttcatggtttcgcgcagccagtattgggctttccagggctgtccggcgtagttgtaaaggtaaatcatgtgctgtatgggctggttgccgtgggcatagtttcccatgccggctatctccatctcgcgtatttcgtggatgacaccgccgtagtagctgtcgtcgaagacggggggcaggctgaacacggagtcgagcatggcggtgaacgtctgcttgccgcccatcaggtcgatgagtccctgtacgtcgtggaagacggaccaggtgtagtgccaagagttgccttcggtgaaggcgtcgccccacttgaaggggttgaacggtgcctggaaggtgccatcggcgttgcgtccgcgcatcaggcgggtttcggggtcgaacacgttgcggtagttgcggctgcgttgcttgtagagttccagctcctgggcgggtcggcccaggagctgtcccatgcggtagatgcaccagtcgtcgtaggcatactccagcgtacgtgccacgttttcgtttatcttcacatcgtagggcacatagcccagcttgttgtagtgttcgtagccgtatcggcccgtgctggcaatgcgggggtgtacgctgttggctccgtgcagcagtccttcgtacatcttttgtgcatcggccttggtgatgttctttatgaaggcgtcggccaccacggaggcagagttgttgcccaccatgcagcctcggtgcccggggctggcccattcggggaagaatccgctttcaagataggtgttcagcagtccttcctgcatcttctcgcccatggaggggaagacgaggttgacgaaggggaagaggcagcggaacgtgtcccagaagccggtgtcggtaaagaggtgtcccggcagcacctgtccgttgtaggggctgtagtgcacggtttcgccttgggcgtttacttcgtgaaacatgcgtgggaagagcaccgagcgatacatgcaagagtagaacgtgcgcaggcggtcggtgttgtcatcctccacgcggatgcgcccaaggatgtcgttccatgcgcggcggccttcttccttggtctggtcgaagctcttgacgcctatctccttcaggttcagttccgcttgttcggggctgatgaacgaggaggccacgcgggcatgtacctgttcgcctttcttggtggagaagccgatggcggcacctacgtggttggattgcagttcgaggtgtttctccacggtatgatagtcagcccacactttgttgaaggtgaaaggcttgtcgaagacgatgacgaagtagttgcggaaattctggggcacgcctccgctgttgcgtgtggtgtagcctacgattttctgctcttcggggatgaccttgatgtacgagcctcggtcgaaggcgtccaccaccacgtatgccttgtctgcctggggaaaggtgaagcggaagtaggcgcaacgctccgtaggggtgatttcggtagtgaggttgtattcggacagatagacgctgtagtagtggggcatcgctttttccgccttgtgcgagaaccacgaggcgcgctgctcctggtctatcttcagccggccggtcatgggcatgatggagaattgtccgtagtcattgatccacggactgggttgatgggtctgcttgaagccgcggattttgtccgaggtgtaggtataagcccatccgtcgcccatctttccggtctggggcatccagaagttcatgccccaggggcgggcgatggcggggtaggtgtttccgttggagagtgatatcttggagtcggtgcccatcagcgggttgacgtagtccaccggctctttctgctgtgcatgccctgcaaggatggaagtcgctacggtaagtgcaaggattattttcttgtagttcataggaatgaggttgataatgtgaatactttggggagagatgtttgagtactgattaagtggattttgtttcatttatccgcttaatcagcatttacatatttgcttttttattggaacttaaaccatccgtttcctgccggctggatgaagtacgtatttccgtccttctcccatacccagagcccactttcgcagaagagcaggtcgatgaggggcttgaattgttcttttgcgagattcacgtcgttgccatagccgccgaagggagtagtgatggcggtgtttctgaaaagcacgcacgagtttccgttattggcggctgcgttcagctcgaagaagacatagtgccacttgcctgcatcttcatcgctgatgctgcccgggcagatgacgaggttgcgcggcgagcggttgtccatctcgagttgcgactcgggcatcagcgagaggtcgaggctgcttgccttggcatcgatgatgtgggtgttccagttgcccatgtaggcatctgtccaggaggcgcctgcgttgaaatcgaagacgaggctggcgttgccgatgacgggctgtgtggcaccgtcgtagtcgtaagtgatgcttttcagagcgtgtcccttgatgtccagacccggggcggtgactacgccgaggcggtcatcctccacgttgagcacgagggcatggttggtgtgcaccaccttgccgtccgcgatgtcggtgagttgcatggaccagttgttgtcgttgtccgagctcagtgtataataggccagtatatcgcctcccttctcacggatggctccgcagctgatgttctcgagggcctccacgcggtggaggatggcagccttggtctcacggttcgcggcaaggtcggccgtggtgacgggcgagaggttcatggtgagtccgtgggcctgtcctgtggctgcaatgaggtcggaggcatagctgctgataaggaatgtggattcctggttgttcttgaggtattgcagcgaggtgtttcctgccaaggtcagcagcacggtctgttcgcccttgaagtcgaggtggtattgtgcctccagttcggggcggagtatcttttcgtttgtgttggtgatgacgtttccgttttcgtcgaactgcaggtagaagtccacgccttcgtaggagagtttccagccgtcggcggcgcagagtagtttcttcacttccgaggggcggaggcgggtttcttcgttcatggttccctggtcttcccagtctttccatacgtcggtggtgccgcagccgcaaagggcgaagaggcacgaggcgagtagtgtgtatcttatctttttcattgtttttcgttttagaatgttgtttttcggtagtttattcagaaagcccgcggtgcaagcacggcgcgcgggatgcgcatgggtaccggtgcatacgagggtggcgtataaggcatcatcgtgccttgtgaggcgtatcctttggcggctccgggcgagcagatgcgcaggtcgatgatgggcggtatcacaccatcgtcctcaatctgcagcagtccgtcttctttgccgtcgctgtagccgcccgagatgagcgggagtagtccccaggggttgcgcatcacgaagaggtacttgttcgagggcggcagcaggaagttgtaggcgtggaagttcaccgacttgtattttccgtcgatgggcttgtctccgtccttaaatccgcctatcaccagctggcgctgcatcacgagtgacactacggcgcgtttcatatccttgcctgacagtacgccgggggcaaacgaataggtgttaccgcttccggtgaggatggcagctacgtattccgtggcgatgccgttgatgctcgacgagcctttatagacttgcagccacttgatgagtgctttctctatgatggtggcccaggtcacgttgttcgtcttgcccgagcaggcgcccagtttgttgccgtcggccacgaagtagttgtctacgcacacttccaccggtttccccatggggtcgaagaggctgacggcatacgtgttgccttccttttccttcagcatgctccggatgtatttgggataggtgtatgccaggtcggccataacagccaatgcgcaacagtctcctatgctatgctggttgatgtcggcaggcagtgggtcgccgaaggggtagatggagcctgccacgtcaaacgttttccatgccagtccgtcgaatgtctccggctgtgcggtagcgtttttcagccattccaaatcttgggcggatgccttgcggtcgctctcgtggatggtgcccatgggagtgatttgcgaggcggtcttcccgcctgccaagcggagcaggtcgtctatgttctcgcccgtgcttgcggcggcagacagagtccattcggctatctgggtgctttcgcttccggcattttgcttcacgttgagacggtagtaacggtaggtcacgttgttttccacttcatactccttcttctccttgcgcgagccgaaggtctggtcgctgcgcgagtctatcgtcttccacgtcttgctgtcggtggagccttccagcgtccatgccttggggtccatttccggagcgtcgtcggcagaggtgagcgagtaggagagtacggccacgttgctgttgccgttccaggtgatgctgaagctgttgtggcgcgtgcagtatttcgtgcccgcatctccgtccactagcttggctatggagcaggcctcgggtgcgtccgagtattgtgccactacagttccgccgcagggcatgttgcggttttccgcgggcagcgagtggtaaggcgacgagttgtcgcccttgttttctccgcccggtccatctccgctgtccgaggagcacgccggcatgcccgtaagcaatgccgccgcgctcaggatagagaaagtgaacaatcgtatggatttcagtcttatcatctgttatgattttagttgttcgtttctcgttcttattcctggctctctcccgtctctgcgttccagcccaggttctgtaccatcttcgggttacgacggatctcctggtcggggatggggaagaggtagtggcgtttgttgaagacacgtgtctcggtcactactttctcgaagaaggcggggaagtctgccttggaattcatgccgtggatgtctccgccttcaccgccacggtggtaagagggataaatccagtcgtcacccacggccatgtcggccaccttccagcggcgcacgtcgtagtagtagttccattcgtaggccagctcgatgaggcgctcgcgacggatgcgcttgtccacgttgtcgcggtcggcaggataggtgaggaagtcgtaaccgttggcatccttgccgcccttgttgccgtagcccggcacaccggcgcgtgcacgtaccagattcacttgctgcatggctccttcatagtcgccgcaggcactcaatgcctcggcatagcccagatacatgtcggccaggcgcaacaggttggcgcagtgcttgccgctccatacgccgttgatgggagccatcttgcgtacgccatatccctctaccggggcgtcgtgtccggctttgttgaagcctgagttgccgttcaggctgaacacggaggtaatcttgccctggttggtgtcgtctttcacccaggtggagccgttgaaggtgatgttggcatagaagcgcgcctcgcggtttttccattgtttcagtacgtagttgggttcgttttctttctcgttgcgtgccaggaagtagttgcgtgcgggattcatcgggttattgtagtcctcggtcacggtgtacatgtcggccgaggggatgccgtcgtattccttgtagtcggggtcgtccacaatgcgcacacccttgtccgtaaagaagaggtctaccatctcttgcgtggtgccgaatcccagaccgccgcggatggagctttcgctcgataggtgtgcgtggtagggggtcacttcgtaagtatggtcgctgtggtctgccagacggatgaaaatctgctctttgttgtcatcgccgtagtgtacgccgtctgtaacttggcggtacgattcatagaagtctactgggccattgctgcctgatacggtgtagagcttgtactggctgccgaattggttgaagaagtcggcgtatgcctgccgtgcggcttcccacttggcttgtgagtattcttgcgggaagagctgcttgccgtctttgttgcgtatttcggcataatcgctgttgccgttgaagagcgggctggcggcgtaaagaagtactttcgctttgaaagccttgcaggcgcctttgtcgatgcgtcccaggttggagccgttgtagcggtcgggcaggtcttgagctgcgaggtcgagctcggcagtgatgtagtcgatgcattcgtctacggagttacgctctttcagcagttcttcgagcggggtgtccagtgccagggcatcttcgcctaagagcactaccggcccgtacatgcggaagaggtagaagtagtagagggcgcgcagggcacgggcctgtgctttccacaccaggcggtcgttggcgctggcttcggcacagcggtccacgttggcaatgaaggagcttgccttggagatgcctttgtagtaattgatgaaccagaagttgatccagctggacgaagcgtaggtcatacccatggtccactcgttgctggaatgccagctccaggtgatgttggcttcgagcgaggcaccggtaacaatggtacccggctggtcggagtagttggtgctgtagcgttctctggtttcgtcgggcacgtagctgtatacgttgttcagaaactgttcggttttctgacggttggtgaaggtgtcttccatgtcatactgttcgccgggtatggcatcgaagaagtcgttgcatgagctcaatcctacggacatcagcagtcccagagctcctatcttgaatatatttttcatgagttttcttgtttgttttgacgggtggattagaaattcacgttcactcctatggaataggtgcgcgagttggggtacgacgtaccgttgttggtgttcaactctggatcccacagcttgaacttcgagaaggtgagcaggttggtacccatcacgtagattcgtgcgttcttgatgaacgtcttgttaagccatgccttgggcaagttgtaggcaacggtcatctgcttgaggcgcaggaagctgacgtccttctgccaccaggtactggtcttggtgttgttctcattggccgtggcaccgtattgcaggcgcggatagaacacatcctggttggtggggtcgtcggccgaccagcggtcaccgatgttgtcgtagaggttagagtagcccgatgtatcggcaaaggggtggatggcgttgcccgagaggcagcggtcggcctttgcggtacccgagaagagggcgccgatggagaagttacccatctgcaggtcggcaccgaagccgtagtagattttgggcacgtcgccttggccgatgaggcagcggtcgtagtcgtcgatgacgccgtcaccgttcaggtctttgtatttcacgtcgcccggacgggatacttgtcccggatattcttcaccgaactgcttggcatggtccatgatttcttcttcgctggtgaaaaggccttcggcaatccatccccagcggccgttcacgttggtgccgcggcgttccagccaaggatatacggctgcggggtcgtcattctcgatgatttcgtcttcattccaggagatgtttccgcgtacggtcaggaaggtactcttgcccagttgctgcatgtattccagcgtggcttcgatacctttgttatccacgatacccaggttgccgtaaggcatttcaatgaatcctgcatagtcggggatggtggcacgctgcaggaagatgtccttgcggtgctccttgaagaggtctaccgacacggagaggttgtcgttcaggaatttcaggtcgatacctaggtcttgcttgcgtgaggtagaccatcctacgttggctccgtacttggagaagccccatccgcctacaccgtcgttgttcacaccgaagcggtagccgcctgtgcttcccatctggtcgaggtacatgaagcggcggttggtaacggcgtccgtacctacaagaccgtcggtatagcgtactttgaagtaagagacgtatttctgcaacggttgccagaaatcttcgttggagatggcccagcccacaccgaatgcagggaacagaccgaaacgtttctgcgggctgaagttctcagaaccgttgtaacccatgttcacttcaaagaagtagcggtcgttccaggagtaggttccgcgaagggcgatgccttgttgcttgtagggtagtgaacctaccagggtaccattgtcgtctttggagaggttctggctggtacggtagttcttctggctataaaggaaaagcccgcctacgcgatgcaggccgaaggagcggtcgtagttgagcgaagcctcgaaataagtgctgcggttatccgaagaagactgctcgaaactcagttcgtggtttccttgataggtacggttcaagcggtattcgccgttggcgtcgaatacatcttcgttccacaagccggtttcgctgtctttggagccggcaaagtagtaggtgtcttcgcgtttcttatagtagagattgcgtgagttgttcacgtcgaaagctatcatggctgtggcgctcagtcccttgctccacttccagaagccgaggtcttgtgtcacgcggatgttggagttgagctgattgcgtgcttcgttggtatatccgcggcgtgtcaggtcggcgtatggattacggaagtcaccgttggacgatatgccggggacagaaccgtcgggcatcaacttggggaaatagaccgggttgatgtccatagctgccgagaaaaggctggaggtggactgctgcgggtagtttccttgtgcgaggtagccgctgaagcccaggtcgatggtggtggtctcggtgggtttcaggttgaggttggcggtgtaattgtagcggtcgtagcgcatgttggcatcatagttctccatttgtgcggtacgtgtcaggcctcgttcgttgtagtagctcagtgagacgtagtaagtggcattgggcacaccgccgcgcacgctcatgttcacacgacggttgtggcccaggtcgttgaagagctcgtccatccagttgacggccggatagaggtattggttgaacatcgtggggttgtcgttcggcagcagaccgttggccttcttcgtggcctcgatgtactgcgaggtatagagcagacgtccgttggtgttcatgttcgcttcgttggcggcatccatataggtataggcatcggccagttggggacgcttggtcagggtgacgaatccttcgtagtagtcgaggttgaactgcggtttgcccacctttcccggcttggtcttgatgataactacaccgttggcgccacgcacaccgtaaacggccgtggcagaggcgtctttcagtacggtgaacgattcgatgtcttcggggtcgatgttgctgaagctacgttccacaccgtctaccagtaccagcggtttggtgttctggttggtgaaggtggagataccgcgaatccagatgtcggaatcgtcgtgtcccggctcacccgtgcgttgcacggctaccacacctgccagacggcctgcgatggaggaggagaggttggcggtgggcatcttgatgtcatccatcttcatggacgactgtgcacctaccacggacactttacgttggtgtccataggccactaccactacttcgtccagtgccgatacgtcttcggcaagaatcacgtcaatcagggttttcttgttcacggcgatttcctgcggtttgtatcctacgtaggaaatgacaagggtaggattggcagtagtcagcttcagggtgtactggccgttgatgtcggtaatggtaccgttgcccgtatctttttcctgtacgcttactccgatgaggagttctcctttttcatcggaaacgcgtcctgtcactgttccgctttgcgcgtgaacctccagacagaacgttgccaaaagcgcccatatccatagcgctttcaagtgatgttttttcatcccaaataagttcatgttactttggtttaaaagtgaatattaaggttacaaaaaatactcgcgtttttttgcttcggcggcaaaataaggagtttgccgataaggaacagtccgtgtgggtgacagatttttggcaaaagcgggtggtcgctgttgagtacaaggatgttctgtagagtacagtttaaagtaattgtaaataagagttttatatgtgtgtgtgtctatatagagcacaaggagagaacaaggttgtgcctctttttaaagtcgtgttaagcctgaatcggatgtgattttgcttataatggtatacttatgagtcaaattgattaagtggtactatcttcatttgattcatatctgatggaaaatgaacaaaagttttatattacgttattggagattccgggcggatggatggcaatacttgttttgacagagtccggtgcttgacgcgacagacactggtgtttgttataacagacactggtgttcaagacgacgggcacttatgtttgtcagcgtaaaggttggcggtcgtaaacctcaacttggcgtattcaggccttcacttcacgatgctcatcgtgaaaagaagtttcaccggaatccccgatggacagggtgatgcggaaaaaggtgaaagatgtgcaggcgtgaacagggaactaaagtgtcgcttcttcctttggcctgttcttctcccgatactctttcggtgtcatgccgaacatgcgtgtgaactctttgtagaaataagaacggctggagatgcctacttcggttatcacgtcctgaatggagagctcctcttcttgcagcaggcggctggccttctccatgcggtagttgcggatgaggtcgctgagcgacagcgtggagacatccttcagacggcgatagaagttgcgcgggctcatgttcatgcgttcggcaatgaaagccgagcccagttcttcctgcttcaggttgtgggcgatgacttgcagcagccggcgtatgaattccgtctgctcgtgggtagtgcagcagatgtggtgtgccagttcgcccagctcgtccatgtagatttgcttggcctcgtgcttgccatagatggccacgtacaccagctcgcgcaggaaaaggatgtcgtagggcagtgtcagataggaatcagcccacagcaccagttcgcgttgcaccgacgagctgacctgccacgtcagcagcgggatgaaggggatgtgcgacagcagcgtacggttgcgccgaatatgttccatgaagcgctcttcggctcctgcgtataccgaaaggtcggctatgaataccgaaggaagcgagcggcgcatctcttcgaaggcttcttcgatggtgcgcacgggcatgacgtgataatcgtcggccagcaggttgctgacaagccacgtcatttcggcacgttcttcgagcagaaggacacttttcttctctccttcggcagatgcttcgtgagtgacgggggcaaggctcagggtgaggctctgccacggctcttcgcagtgcagttcggtgtgggtcacttcgagggtagattgtacgaaatgtgccagtagctgtatgccgaaggtggagtcggcacttttctgcttgggtggttgggtttgattggtgagggcgtcatgcaaatatttcatgcttttgccctcgccggtgaaggtcaggtacagccgatctccgtggagcgaggcttccacttgggtaggttgggctccggtttctttggttatccgcaggaaacagtagtagaggatgctgtagagcgcattctcgtagaccggaaaggtgagactggaaggggtggagaggcggatgccggtggttgcgatcacttgcttgtctagggtgtgcagcacacgttccagagtttccttcacgttgacctcggccgtcacgatgaagcggttggggaagaagaggtggaattcttcaccccgcagcgtatcgggatgcaggagggcggtcatgagggtttcgcgcatggtttctacggtttcacgctgctcggcaggcgtgaggttgtcggcacggaggcggtcgcaagcctggtagagcagtgtaaggcggtccagcatgctgcggctgtagtccgccatgttggtggcatccggttcatcggggcgctggaagcgtgtggtaaggcggcggtacgaccgtttgcggtggaatgcgtagccggatatccctgccacgagcaggaacagcaatacatatactgcacaagctgtcttgctcaggtaccagggcggcaggatgcggatgggcagcgaatagtatttgaattcattgtcgaagacgtccttcttatattttatatggaggatatagttacctgtgggtatgtgtgtgtagaacgtttcgttggcattgctgaagggcgaccattcccggtcgtatccttccagccggtaggagtattcgatgtcgttggccgagaggaagtcgggtacggcaaaggtcagcgagaaggagttttcgccggccggcagttgcagggcctttccgttgtcggtataatagtcggacaacgccacttggcggcgtcccaggctgagcttgcgcagcagtaggtcggggtagcggtcgggcgtgcttttgtctttctccttcttcagatagagcagtccgtcgatgccaccgaagaagagccgtccggagtaggggcaacggtagtaggcatcgtcgctgaactcgcctacctgcatgcccgagttgtaatagtaggtgtgaaacgattggttttccggattgtacttcaccagtccccggttggtggagagccaaaggaagccgtggttgttctccagtatgccgtgaatcatgtcgttcagcatgccttggctgcggtctatgcagcgtggggtggcgtgcgtggtgggggcgggcaggatgatgaatcccgaggtgctgcccacgtagaggttgcccaggctgtcggcgtgtaggctcagtatatcgtctgtcggtttgtggagcagggacttcagggagatgacggtatactcgtccgttgtcttgttgaactttacgatgccctggccccggcttcctagccataggagcgagtcgcctccggctgtcatggggaagaacatggtaatttctttctgttcgtggaagaattcgtagggcacgacccgtttggtgcggaacagcttcccgtctccttcgaacgtgattttgcggaaaccgctgcccgaggtggatatgtagagcgtgctgtcgttctcctcgtgcaggtcgtgcacctcgacggtagtatcggagagatggccttccacttgctgcagggtgtggtcgtcgtaagagtagaagtagagccccggcgtgcccgtgcccagccagaaaccgttgtaatagcgactctgtttcagtatgtagacgtggaattcccgttcccacttccggtagtcggtggccttctgccggccttcgggggcaatcacttccgttttctcgggcttgatgccctcgtcgtagcgcgatatgtgcagtagtccgtcgcccttggtgccgaaccagaggtcgccctgcgtgtcggtcatgatggagcgcacctgtcggttgaggttgggtgaaaggctgccgagcagcaagttggtggcaatgtcctgcttgcgcgagtacatcagtgccccttgtccatcggtgcccacccagaggatgccttgctgcgggtcgtggaagatgtcgtagatgcgcacgttgcgctctatcatctctatctcaaacttgtgggaggtgcagaggcgtatcagcccatgtgtgcggaaggcgatgatgatgtcctcgtggaagggtacgatgccctctatgtcgtctccatacgccagcagtgaggcgaggttgcggatgtagattttcgtcttgcacgagaggtcatagaggtagaggtcatggtccgagtcgataaagcagaaacagttgttctggtagaagatgtgtcggatggctttgggatggaaggcgctcgtcacagcggttggtttcacggagagcgagtccttctcgaagttgtcgatggacacttgtatcagcgtgcccgtatcttgtgggaagagccagaagataccgttgggggtgacgaacgagcggcggtccatgtcctcggtcgatacggtaggtgcttgcagtttgacgaaccgttcaaggcgcgggttgtagaagtagagtgtatcttgtgcaatgatccatgtgtctccgtgctggttggagtgcaaatagtagtccttgaactcgtagctgcccactaccttgcgggctgtcggcgacagacggttcacgcccaggtgtgtgctgatccagaggcatccgttgtctgcctggttgatggcgtggatgatgttgttgttcagtgtcttttcgggcgagaactcagagcggaagatttccatgtttcgtccgtcatagcagttcaccccatcgtaggtacccagccacatcagtcctgctgagtcttggtagaaacagaatacggcgctgtgtgacaatccttgctgatggtctatcctgctgaggaaataagtattgtccggaacagtgttgccggctggagacggcactgcctgaaggagcaggacaattattagtaggaagtattttttcatatatattagtagtattcttttggcgtttaaaatacaaatgtagaaaattcttcttttggagtcaaataatcttcctgtttgtttgctttttgttcatgaggcggtttctgcgggcgtggctgtttcggtgggggagggagggcaacccgaaagaggttaattcacgttaaagtgaaaacttcaatcctttggctttcaataacggttacatggaggtaacagactgagttctaagtgccttattgtgtgacatgtggcagtcgcctaactttgcggctgtaaatcaaaacatataggagaaatcattatgaagaactatcagaaggtaaatgtgcccgcaggcgaggcacgtgtcgagctgcacgattcattgaatctgaccggtgcggaagtatccatcagtaatctgccggcaggcggaggagtgccctttgtgcattcgcacaagcagaatgaagaaatttatgccgtcctttccggacgtggcaccatggtgattgacggagaaaccgtagagttgcaggctggtgactggcttcgtgtggctccggcaggagaacgtcagttgtctgccgctgcggacagtgccatcagtgtgatttgtattcaggtgaaagccggttcgctagagggatttacgatggcggacggtgtggtgaagtaagggaggctctctctgtctttgcataggatatttacagtgttatacaggcaatgcgggtttcttgtttcttcggcaccggggaaggtagagcttcccggtgtcggagaaattgccttgagtacattgcttaagatttcgtaagatggtatgaagaaagaaccgcttccgtgcaaacagcgatatccgtatcattgcatccggtgccacgcgttcggatggtcttgtgctgaaggatgtagaccgtattaacgggagtgatggcagtgacggttccgatggtggcggcgaccagggtgagaaccctttgggatagtagtctgtagggctgaaaaagttccgatgatatagagactgtaggtctcctttccgtactatgtgcgggggggagaccacggctctttcatttaagggagttagaggagttaaagccaatacttctgtgactacatagacaagagtatcggctttaactcctttacttctaacggagcggagcgaagtgataacccctataactcccttaaatgagaaagccgtggagggaggccttgtctttaggtaatgttctctccaaaaataaccggattgcctttcttgaacaaacaattataaatatctttggagcattattcactcattaaactaacagaaaacaccatgaaagtcacaaacaaatcaacagtgagagtaggcgcggcaggagtcgcagtcattggaattatagtattgttcttggtcatgtttgccgtggagcgtattgattcgggacagacgggcatcatcgtcaatctggccggtagtgagcgtggagtagatgatgccaaggtggaaaccggatgggtggtttacaaccgttttgccaagcagctattcgaatatcctgcatttgcgcagattgtagactacgaacctttcgacattcaggacaagaagggaaccatcttcaagacagaccctactatagaatacttcattgagcgggaggatgccaaagtagtttttctacgctatcgcaagactaccgaagaattggaacagagtgttatcctgacggaagtgaagaacgcttataaggacgtggcaggactctatgagacggattcgctcatcaacaaccgtccggctttcgagaaggaggtggaggcattactgaaggagcgtctcagtacccgtggctttacgtttaccaacatacagtcgtccgtgaaacccaacgatgtactgcaagctgccattgacgaaaagaatactgctgtgcagaatgccttgaaggtggagaatgaaaagaaagccgctatagccgaggcggaaaaggtagtagctgccgccaagggtaaggcagatgccaaccgtatccttcaacaaagcatcacgccggaattgattcaactaaaggctgtggagaaatgggacgggaaattgccgttgtctaccggtggaaatacgttgccattcctgaagttgcaatgacaatctctatgagaccccattggcaacttgattcttttggggaggtactgattgtgtgcgcggataatcacaaataaatcaagcggtaagccatctatctctctatttgctaagatttattcgtccgatacttgttgaattatcgtccgacagccgttgaattatcgtccgacaattgtcggacgataattcaacggctgtcatgggccaagtttgtttaatttttaattcgtcccaattttaatgggacactaatgaagtatacagaattataaatacgaagaaaaagctcctaaaaacatacagaaacagctcgtataaagcagaattatcgggcttatacgagctgtttttagaatatagggaaaatttaaataccttctatggcggaagctggaacccaccctactttaccgtcttccaaacgaatttctttccattcacgcatagagttgtcttttatttcaactttacgtccctcatgaagaatgaacagacttgtaccactttcactgggagtactacgcactgtgacactaggtgctaacactatagcttcactacgttccatcagttcgcctttctgctgagcagcaaacacattactcaatataacaagagccaggaatactattcctgcaataaatcccactttcttccccataatctgttttgaaaagaaaaagagatagaatgaaacgagtaatagtacaaagaacacaatccccaacttagcccatgcatctacgctaagacaattaatcaacgatttagtccaagatacaaagaaaacctcaggaactgggattaccttatcgattgtcttagaacgtgctatttccaaatttgcacgaatatcagcattaccaggttccaacaacaaggcacgctcataattcaatatagcttttgctatatcatctgccttataataactgttgccaagattataatagacctctgcagcctctcccttctttaacagattctcatatatttgaatggcagaagcataatcattccgtatataggcgctgtcaccttcagcctttgtcacattgctttcttgtcttgcagcagagaattccgcatgtgaaccgacggatgtagagtcactaccagtctgtaatgtatctacagatgcaggattctgcccataggcagtaattgccatcactagactaagagtaaaaaacaatattctattcattaccatttcctcctgattaatgttttatcgagttttccattttgctgataacttccaaagaagctgaatataccttatccatagcctggttatcatcacccggagcaaagcgggcaaactcacagttgttcaatgcatcgaggaattcctttatcaacgcatcattcacaccataattacgaagttcctcttcgatattatccttagacaaacgggataccggaatgttcagtttatcactgatatacccccaaagagccttcaaaacctcatcataaaatgcgtctttcttattctcggccaataatttaccagcttgtttcatacgtttcaccgccactttattggctttcttagtacgcatctttgctacatttgcattggctgctatttgcttacgatagatgataaagaatgtaatgaatgcaatacccggtatcaaataaagcaaccaatacgtcaacgaaccgaagaagaaatcacctttgggagacaaagtgacattattctgcttgataaaacgaatatcctcgtttaatactttcaagtcttccttgcttgtaaagtttgcaatggtctgagctgcattacctgctcccttttccacatgcaattcatactcttccgtagtcagcgttttatacgaacgggaattaatatcaaaataactgaactttacggcaggaatcttataagttcccgcattacggggaattgccagatactcaatgaccttactaccggagaggcccgaatttgtcagacggaatttattgtccaccttcggatcatatacctcaaaatcctcggggaatttgacttccggattagaaagcaacttcagattgccggtaccagagatgacaagtttgacagtaacggcatcattggtcttgacatttgtactattgatagaagaagttatattgaactctcccactcctccagaaaaatcagctggcttacctactggcaagggttttacgtcaatcgtcaattgcggagtcaaaattgtctttttaacttctacgtaattgcttcctccattgaaaaatgcctcgaacggatcagcaacttgtgtagcctttgcaatggaagcgtcaaagcgtgcagcatcaatcgtcaacttaccggcttgttgtgggaacaacacaaactgacgatagattgtagactgataatttctacctttataatgctccaatccccatcttctgtcattaggaagttccacttcctgagaatggaatcctttgaagtcgggcaacttcacattgtcaaacatacgcaagtccaccaaggtatatatcttatatgtcaataggaatgcttcttgttcatacaccgtcgtcttactggcagtagctgtaataaacaaatcactattcgatacagatgtcccggaagaagcgcggctggcagtgccactgctctgtccgccaccatttcctgaggatgctccattggtagcctgatctgccggaagaatccttactcgtacagaattagaaaccatttggttaccatcagcagtgatagtggctcctggaatggtaaaatcaccttctgcagtcgccattaaaatataagtgaatgtaatactgctggttgaagtcgtctgcccattaatcatctgcacgctactctgttgcgagcggctgggccccatcaacacatcaaatcccttcatagaaggagcacgaaaatcccttaccttttgtgtagtcaccgtatacgacagtctgaactggtctcctaccgccacagcgtcaggagcagacgcagtaaacgataccttgccatcggcaaaggcattcatactggctgcaatcagtgctatccataagaaaactatttttctcatatattattcctattatgtttgttaccaatctttttccagacgacctccttgaagtacctgctgctttttcactttatcctgcacatccttctcgtcttgcatgacagagttcaacagctgttcggcattttccttagacatctcattatctttcttttccggctgagaaggttgttgttgttgctggtcttgattctgttgctggtctttctgctgatcctgctgtttatcctgctccttctgttggtcctgtttatcctgatcttgattctgatcctggttctgctgctggtcttgcaactgtttctgtgccaaagcaaggttatagcgcgtttcatcatctttcggattattgcgtaacgactccttataggcttctaccgcctttgcataatccttctgagaatgaaagatgactcccatattatgataaatctgtgccaagttcgatttgtccttttctatcttggtagctcccacatattgctccatcgcttcctgcagcttgttctgctgggtcaatgtatttcccaagttgaacatggaaaccgttgacttcgggtttacctccaaagccttccgatagttcacttctgcatccacatatacgctatccttaaaaaaacggtttcccttacggatataatcgcgttccgccttctgtgcagaagctgaagctgccactaacagcagcaaaactattccaatatattttttctgtaacatacgcatcatttcttattagagaataaatgaatgttgcggaacagaggattcttgcgctccaatatcaacatctcagccagtaacaacagcagaataatccatgccactgcctgaaactgttcattgaattccgtgtacacctgtgtttccacatctgcctttgccatcttattgatttcctgactaatcgctttctgtgcaccattggtattgtctacgcgcacataaataccatttcccgcctgagcaatttcctgacacatctgctcattcaagcgagtaacgattacattaccttcacggtcacgacgataatcattagtaccctctattggaatgggggcaccctcgggcatacctacccctaatacattgacctggatacctttctctgcagcaaccttagcagcttctacggcaccaccttcatggttttcaccgtcggtgatgacaataacagtacgtcccaccccttcttgaggtgtaaaactccgggcagccagatttattgcagctccaattgccgtaccctgcttggaaatcagcgaagggtcgatggactccaaaaacatcttggcggaaatataatcactcgtaataggcaactgggtaaatgcgtcacccgcaaaaacaatcataccgaccttgtcattctgcatcttatctaccaactgtgccaccagccgttttgccttctgcaagcggcttggctgtacgtcttgtgccagcatggaattggatatatccaacgcaatcatcacttccactccctgacgttttaccgtctccagtttggaaccaaactgcggacgtgccaacagtaccgtgaacaacccgatagccgcaaaaaccaaccaaaacttcacatccggacggtatttggaaacatccggcattagctgtgccatcagtatagggtcaccaaacttacgaatggctttcctcctccgataattggagtacaagtagaaggccgccaataaaggcagcaacagcaacaagtacaaatatgcaggttcttcaaatcgaaacatctttttatttacaatttagcaatttacaatttacaatttggctacgcaatgactgatacactaaaagacattctcctttttacggtatcttcttcaatatagagttgcgtaacagtacctccagtaatacgcacaagaaagcagccaacgcaaaccagcggtactcttcctggcgcttgctgtattcttttacattcaattttgttttctccagcttgtctatctcctcatacacttccttcaacttcgagttgctggtggcacggaaatagttaccttccgttgttccagcaatctgtgtcaaagtcttttcatcaatttcgacgggcatattgacatattgcactgttccacctaccggataaggataaggagccataccattggttcctaccccaatagtataaacgcgaatgccaaagctcttggctatttcagcagctgtcaaaggagaaatatcacctttattattgacaccgtccgtcagcagaataatgactttcgactttgccttgctatccttcaaacgggtaacggcattggcaatccccataccgattgccgttccgtcttcaatcagcccgcacttcatatctttaagcaagttcaacaatacggcatggtctactgtcaatggacattgcgtaaagctttctccagcaaacaaagttatacctatattatcattcggacgtccgttaataaactctgccgctacatccttcgccgcttccaaccggttaggtttcaggtcttcggccagcatactggtagaaacgtccatggcaagcatgatatcaataccctcaatctcactgttctgccagctatcggtggtttgcggacgtgccaaaacaagaataatcagtatcaaggcaattatccgcaatacaaacggtacatgcagcaagtagttcttatagcttttaggggtatgggcatacacacgggcatccgaaatctgaagcgtagcttcactattcttccgcttcataatataccatactatataaggtataagcaacagcagcaaaaataaatattcaatattggcaaaaaccatatttatgtacgatttaacgatttacaattcagcttcgctccaaacatccctcatttttcactcatgtatatccgattgaagtcactttttcagtattaagcaaaataattatacaactccaatccaatatatatcaaggaactgacaagggctacagccaacactacaatacccgctcccagcaaaatcttggtacgcaaagaacgtttctcgataatggtaatctccgtaggctgcggtttagcattctcctcttctttctccttggtttcattaataaagtcaatggcattaatcaggttagcgtcattttcgttcaccaatggattatgcttggcaaatttcaccaaatcagcagtctggaacaattcacgcaaatctgatagagcttccttatctttcatttccagcaacttatctatgatttccgtagaagtcatttccaaagcattgaaaccaaaacggtcttttatatatgtacgaagagcatcagtcaattccgtataatattccttcggctcccctttctgccataccttctcattcttgatacgttctatctcctgcatagccaactgatggggaggcaacttaggttctaccttcaccttacggataataggcttattgtcgaagaaacgcattatcagatagacaagcaatatccctatcgggataatcagcgcaccacaagccataagaccataccagtcttcccaagcaaaaggcgcttgcatcactgttttgggaccgaaaaactgttccggattctccggatctaacgggacattcaccgaatatactttcaatgccaacgctttggagcgatacttctcattatccaccgtcacttccataggcggcagataataaagagccgaatcaaaagaggtaactgtatactcttgagttatcaatgcacgccggccatcattcagcaattgcgtatccggtttggccacatcaataatttcaaccccattcaccagcgtatcggtatataccgggaatatggcacgcttatcggcatctagagatacttgaagctttatctttgcctgctctccaataagaatctgcaaagagtcaatcgtagcatctaccgttaccgactgggctactacccttcccgaccatgctattaataacgctatcagaaataaatatcttttcattttccgattaatttcgtttcgcaaacaaattcatcaatgccttgacataatcctggtcggtacgtaccgacacattgtcgacattactcttggtaaacgtttcattcagttccgcctgcttgttcacccaccagtcatgatgggcacgacgcacggcacgcgaggaggtgtcaatccactgctcatgtcccgtctcggcatccctaatcttcatcagtcccacgggaggcaattcttccacacgacggtcgtacacctgaacggcaaccaggtcatgcttacgattggcaatggtcatggcgttcttgaaactttcctggtcgatgaagtcggacaagacaaatgccgtgcaacggcgtttcattacgtttgtcagatactccaagcccagacgaatgttcgtcctccggctttccgcatgaaaatctatcagttcgcggatgatgtaaagtatatgcttacgtcccttcttgggcggaataaacttctcaatccggtccgaaaagaagatgacaccaatcttgtcattattctgaatggcagagaatgccagtgtggcggcaatttccgtcaccatatccttcttcatctgctttaccgtaccgaattccaaactaccggaaacatctaccaacaacatcactgtcaattcgcgctcctcctcaaacaccttgacgtaaggcttgttgaagcgggcggtcacattccagtcaatgtcgcgtatgtcgtcgccaaactgatactcgcgcacttcggagaatgccatacctctacccttgaaggcagagtgatactgcccggcaaagatattgttggacagtccgcgcgtctttatctcaatctgacggactttcttcaaaagttctgttgtttccattgatttattttaataatctcatttaagcacacaagcgcaatttagtttataacagaaacttccctatgaaaaggggtgaagttttcggtactcaaccctaaggtttacgacgctaacctcaggtattggattgtaaacctcaagtttacgaaaacctctattatgcgttagggcacttcaaccttgttcagtatcttgctgacgatttcatcagatgtcatattgctggcttccgcctcgtaagtcaagccgatacggtggcgaagtacgtcgtgtgccacagcgcgcacatcctccggaatgacataaccgcgacgcttgatgaacgcgtagctacgggcagccagggccaagttgatggaggcacggggcgaaccgccgaaaccaatcatgtctttcagctctttcaaatcgtatttttccggataacgagtagcaaatacaatatcgacaatatatttttcgattttctcatccagatatacctggcgaaccaccttgcgggcttcgataatctcgtcagccttcaagattggcttcacgttgaacttctctccattgatattctggcgaataatcagtttctcctcttcctgcttcggatagtcaattacaactttcagcatgaaacggtccacttgcgcttcgggcagcggataagtaccttcctgctcaataggattctgcgtggcaagcaccaaaaatggtttgggcaacccgaaagtttcattgccgatagtaacttgacgttcctgcatggcttccagcaaagcactctgtactttggcgggagcacggttgatttcatcagccaaaacaaaatttgcgaagaccggacctttttttacttggaacgtttcatccttctggctgtaaaccattgtacctattacgtcggcaggcaacaagtctggcgtaaactgaatgcggctgtattgcgcatcaatcaacgaagcaagcgtcttgatagctaaagtctttgccaaaccgggcacaccttccaacaacacgtgtccatcggacaacaaaccaattaacaacgactctaccagatgcttttgtcctacaatgacctggtccatacctgtggtaagattggtaacgaaagcactttgtctttcaatccgctcattcagttcgcggatgtcaattgtttcagccataaatcattctatttttttaatgtttaatttcctcatttatccggttttgaaccggtaattattttttcgctcccaaaagtacgggaataaattaaccataccaactaatttttattaaaaaactatgcgaaacctttagattaaactactttcatagagtttagtatttaacaaaaaaagaagcagtaattttttactgcttcttggccaattttggtatcttgatagtagtaccataaggcacattatccggattcttgattacaccgggattatgcttcacgatataagaccaaagagcttttgttccataaaaacgaagcgctaccctagtcagcgtttccccttccttgatggtataagtggtttctgttcccacaatcgtataccccacagaatccggttcaaacggtacaactgtctttttttgctcttttttaggagtgggagactgtacttgtacattttcctttggagtttttttaagcgtaggagttgttgcagcaacagtttctgccacagtatctatccgagcaggagctacaacatcttttgaaacaatactgtctgtcaaggcaatattgtcttgaccggcaggaacctccaccttttcagtaacagattccctcacatccgagtctgcaacttcttctacaagaggctttgcagtaagtgcgtcaagcaagtccggataatacatgaaagctacggcaccaccacacagcaacactacaaaaacaacgatgcctataaaatatttcatagtcgaagaatctgccatatcttttatcactggctcagacggttccggctcaacagcaactatattttcaggcattgcttcaggttccgttttttccggtttctcctcttcaactgccggttcgggctcaattaacggctcttctattacagtttccaccaaaggttcttctatcgtagcttcttccactaaggtaaccttctcctccacctcttgttccagagttttgatttcagtatcttcatcatcttcactgtcattttcctgcagggtatcctcaagtaccgtagcgtcattcaaaactacagtttcaaaatgcgaaaatggtctattgataatatctttcaaggccggttccggtgtaaacgacacttttgtatgcccttgtatctcaaacctttcccccgtattcacattaacgctttcacgactcccgacatctatcagtttgaaagtccccaaacctcgtatcttcacatacttatccttctccaatgactcctcaatcagctgaaagaattctttcacaaaactatccgcattcttcttgctcatgccatgcctttcagccagcgtgtcaatcaagtcttgtatgttcagtttctcattcataatacgggagatttttttaaaagccggttacttaaacttatcctttaataatgtactcggcttataagtcaacaccaatttaggaggtaccagcatacgctgctttgtagtcggattcacagatatacgttctgccttctttttcacttcgaatgtaccgaacccttgtatagagataatattcccctcctccaactgccgtgccatatccgacagcaatgaagcaaccagctcagaagtatctttcaatgtgtatcctaacctccgcgataattcagaagtaaactctttgttattcaaaatgtaagcctttaaattgaactacggtgctatattagcaaatcttcttcacataagcaagaagataaggaaaaatctttaaattattcgcccaaaaaggtcgaaatcatcggaatttactatctctacgtggtaaaagttacctatatgcaacgctttgtctccacgctcaatcaaaacctccggatccacttcgggagaatcaaattctgtacgtccaatataatattcgccttccagccggtcaatgattactttcatctgcctgcctactttctccgcactcaactcccctgaaatgccttgctgaatagacattaactcatccaggcgggcttgtttcacttcctggggaatagaatcctcatattcagcagcggcatacgttccttcttcttccgaatacgcaaaagcccccattctatcgaaacgcactttacggacaaactctttcagctcctcaaaatcggcttcagtttctcccggatgccccaccatcagtgtagtacggagatggataccgggaacctcttcacggaattgctctatcaacttatatgtctcacccttcgtcacatgacggcgcatcttttgcagcatattgtcgctgatatgctgcaaggcaatatccatatatttgcatacattgtcacgctcacgcatcacacggaataaatcagtcggaaaatgtgccggataagcataatgcaagcgtatccactccactccgggaatatccgaaatccgctcaacaagctcgggcaacatttgcttcttatataaatctactccgtaataggtcaactcctgggctataacctggaattcctttacaccccgtgcaaccagatacttcacctcgtcaagtatctcctccatcgggcgcgacacatgccgccccgtaatgatagggatagcgcaataagaacatttacggtcacatccttcggatatcttcaaataggcataatgctttggagtggtcaatgtacgctctatgtgcaactcgtcatgataggcctttcccaaatcctgcaataactctctccaattgaatttaccatagaatttatccacctggggaatttcaacggccaattccttcagataacgttccgaaaggcagcccattacataaagcttctccaagcttccttcctccttggcctgtgcaaattccagaatcatattaatggattcctccttggcgtcaccaatgaaaccgcaagtattgatcacggcaatctgccctttcggcctttccgcatcatgtgtcacatggaatcccacttcctccaactggcgcatcaaatgttccgaatccaccaggtttttagaacatcctaaagtaatgatatctatagtcttccgtttcatgcattctccccgaacagtgaatcaacaaattcctttttacggaacacctgcaaatcttccatgccttcacccaatccaatatatttaaccggaattttaaactggtctgaaatgccgatgactacgccacccttggctgttccgtccaactttgtaacagccattgccgtaacctccgttgccagagtgaactgcttggcttgctcgaatgcattctgcccggttgagccatccaacacaagcaacacctcattcggagcatcagggacaaccttcttcatcacattcttgattttcgtcagttcattcatcaaaccgactttattatgaaggcgtcctgccgtatctataattaccacatcggcattattagcagttgcggaactcagtgtgtcaaaagcgacagaagccgggtcagcacccattttctgcttcacaacaggcacacctacccgttcaccccatatcaccaactgctccacagcagcagcacggaaagtatcggcagcacccagataaacagactttccggctttcttgaactgataagccagtttgccaatcgtagtagtcttccctacaccattgacgcccactaccataatgacgtatggtttcttcgcaatcggtgcttcaaagtcatccacatcctccgaattattctctgtaagcaacgctgcgatttcatcacgtaaaatatgattcagctcagtggcattcatatatttgtcggctgctgcacgcttttcgatacgttcaataattttcagtgtcgtttccacgcccacatccgaagttatcaacacctcttccaggttatccaatacttcatcatcaacttttgactttcctgccacggcacgcgcaatcttgccaaatacactttctttggtcttagataatcctttatctaatgtttcttttttttccttggagaaaaaactaaaaaatcccatacactaattatttttatgcaacctgttttcgcattccctgcaaagatagtgcaaaccggatgcagaataaaatgaacccgttcattttttatgctgaggtgcagcctatcttcgcattttcagcaaagatataacaaaactgacgaatattaaaaacttcgtcctctttttaaaaagaaatccccttaccggaaataccgacaaggggatctttataagtcattagcgctttacagccactgtatttatcttatttcttaaagaagttctgaacatcttcattacggaccatctgttcatcaaagatgtaagcaccagtcttaggagacttcaccattttgataacctttgtataagaacgtccttctttgcttccttcgtgcaaggttgctaccgctttctttgccataagttatagatttattatttaatttctttatgtactgtcactctcttcagaatcgggttgtatttcttcaactccaatctctctgtggtattctttctgttcttcgtcgtaatataacgagaagtacccggcataccgctatccttgtgttctgtgcattccagaatcacctgtactctgttaccttttgctttctttgccataatcagtattctcctctactttagccaataactttaatgcttttccaatcacaataacctttagctaccgcatctttcaaagcagcgtccagtcctttcttattaataatgcgcaaaccattagcgcaaatgctaaggctgatccagcaatcttgctctacatagtagaacttcttgttaaacaagttcaaatcaaaggttctcttcgttcttctctttgagtgtgaaacattgttgccaatcatggccttctttccggtaatttgacaaatctttgacatttctatcttaattttatagttttcttttttgcctatttcaaacagagcgcaaagtaagcacttttatcgttaccaaacaagtttttcttaaaataattcactgtacgatagcattttttcctcatttcagcttctcataaagcaacaaaagggcattttgaattgttttttccacatttccctttcttccctcgtctccctcctgcttcatggtaacgatttcatttttataggcaacagctatccacaccgtacccaccggtttttccgaagtcccacctccaggacctgcaataccggaagtagccactgcacaatctgttttcagcgttttcatcgcacctttcaccatttctgtaacagtttcacgacttactgctccatatttttccaatgttttggcagatacatgcaacaaagacatctttatttcattggaatacgccactatactaccattaaagtattccgaactgccaggaacggaagttatcagagcggcaattcctccacccgtacaactttctgcggtggaaagggacaatttctttgctttcagcagctctcctaccttttcttccagcttcataccttattatatatattatcttaaagttacccgtgaataagcaggtgcttccatcggacaaaaatctttatccatatacttgaaatatccggtaatggcaatcatggcagcgttatccgttgtgtagctgaacttcggaataaatattttccaaccatacttcccggcatgctcacggaaagcattacgcaatccattattggcagaaacacctccggcaacagccacttcctttattttatattgcttggcggctttgcgcaacttatccatcaagatatctacgacggtagcttccagcgatgccgccaaatccgtcttgtgatgttcgatgaaatcagggtcgtccttcatccagtcgcgcagagagtaaaggaacgaggtcttaagtccgctaaaactataatccaaccctggaatatgcggtttgctgaacgagaaggctttaggattaccttgccgagccagcttgtcaataattggaccacccggatatcctaatcccatcacctttgagcatttgtcaatggcttcaccggcggcatcatcaatagtctgccccaaaatttccatatcgttataggctttcaccaagataatctgtgagtttccaccggaaaccagcaagcagaggaaaggaaatcccggctgcacattatcttcaccttctactttaataaaattagctaacacatgaccagtcaaatgattaacatcaatcattggaatacctaatgaacgggcgaaccctttggcgaaagatacccccaccaacaatgatcccatcaatcccggtccacgcgtaaaggccacagcactcaattcctctttggttactccggcgcgtttcaatgcctcatgcactaccggaactatattttgttggtgcgcgcgggaagccagttcaggcactaccccaccgtatgcttcatgcacagcttggctggccaccacattcgaaagcagataaccatctttgatgacagctgcagaagtgtcatcacaagaagattctattcccaagattattgtactcataatgtttatttacgtttaaacgctgcaaaagtagtgataaaagtacgattcataacgtattatttcatatttttgttggctgattataaaaattaaccgcctatcagaaagctaaaaaaaacagtacgctgggtactcggtattgtattgggattgtacattggtaccatattgttgctgaacattccatctgttcagcgacaaatgtctgtatttgttgccaatgaactggcttccatactggacagcaagatttccatcgggcgaataaacataggattgttgaaccgcatcatcatcgacgacctgctcctgaacgaccaatccggcaaggaaatgctgaaagtgacccgtctttctgccaaattcgatattctccccctattcagcagcaaaatatccattagtaacatacaattgttcggctttaacatcaatctaagcaagcagactcccaaggataaacctaattttcagtttgtactcgacgcattcgcatccaaagatacagttcaaaagaaaaacaacctggatctccgtatcaattccttactgatacgccgcggaaaggtttcgtatgatgtgctgtccgagaaagagactccgggaaaattcaatccacagcatctccgtttacgtaacattattgcaaacatctccctaaaagcattacaaaatgattctatcaatgccgccatcaagcgtctgagcatcgaagaagaacattccggatttgaattgaagaaactaagtctaaaggttatcggcaatgaccaacggatgaaaatcgaaaatttcgctatcgacctccccaacacctctttggcaatggatactatacacatggattatgacagtctgggggcgtttgacaatcttgcccaagatgtccgtttctcattccatttgctgccctctcaaatcgccttgcaggatttatcggcttttgttccggcttttggttctttcaaggaaaaattgcaagtagaggtacagacggacggcaccatcaatcaactgaattgcccgcacctttccgtctctgtcggaaatcatttttatctgaggggagacgtatctctacaagacctttcccatccggaaaatgcttatgtattcggtaatttgtccaatttgtacgcagacccggaaggaattgccttctttgtccggaatttcagcaagaactacaatggagtacctcccgtcctgcaacacttaggaacggtttccttccgtggagaagtctcgggctacttcacagacctcgtaacttacggacaagtacgcactgacatcggaaccatccaaactgacgtaaaactaagttctaacaaagataaaggttattttgcctattccggtgcagtgaaaaccaaagagtttgagctgggcaagatgctgggcaacaagaaactgggtaaagtaactttcaatctagatgtcaacagcaaccattacgaaaaccaatacccgtccgtactgctgaaagggctggttgcctccattgattacagcgactacaattacgaaaatatcaccctagatggagaatacaagcagggaggcttcacgggaaaagtcgccttggatgacaccaatggttctgttattttgaacggcaccatcaataccgccagtcgggtaccgactttcaactttcaggcaagcatcgacaaatttcgtcctcatgccctacatcttacacccaactatgaagatacggaaatatcagtcaaagtcaaggcagacttcaccggcggttccattgacgagatgaacggtgaaatcaacgttgacagcttactattcgcagctccggaaacacaatacttcctggacaatctgaagatatctgccataagagaaagcgaaggccagaaacggctgaccatccaatccaactttctccaaggtagcatagaaggtgactactcttatcgtaccctgcctgccagtgtactgaatatcatgcgacgttatatccccgccttgattctgccagacaagaaacccatagagacagagaacaatttccattttgacatgcacatttacaatacggaactgttctccaccgtctttcagattccggtaaaagtatatacccattccaccattaagggatacttcaatgacaaggcacagcggctccgcgtagaaggctattttccccgtctccgttatggaaacaaattcatcgaatccggaatgttcctttgcgagaatcccggtgaccagttccatacacgcctacgcttcagcaaccgcaaatcaaacggcgctgtcaatatagctttagaagcgcaagcccggaacaataacatacagaccacgctgaattggggtaacagtagcactgtaacctacagcgggaaactcgccgccgtcgcccacttcatccgtgaacagaacgaagcgaatgaaagcaagaggaaacttccccccttaaaaaccgtcattgatgtccagcccaccaacgtgatactgaacgatacgctgtgggatatacatccttcccaagtagtactcgactccggcaaagtgtatgtcaatgatttctacttcagccataaagaccggcacttgcgtatcaatggtatcgtttcaccacaacccgaagatacagtacgtctggatttgaaggaaatcaacatcggttatgtgttcgacattgcagacctcggagtcaatttcaaaggagaagccaccggtccggctttcgccagcggagtattggaaaaccccgtcatgagcaccgacttgtttatccgcaacctcggattgaacgaaggcttgctgggtgatgccaacatacacggagaatggcaccacgacgtgaagggcatctatctggatgcccatatccgggagaaagatattgccaaaagccatgtgtatggctatatctatcctttgaagcccactagttcattggatctccaaattgaagcggacggtaccaacttgaagtttatacatcattatatgagtagcatcacgcccgaattcaacggacgtgctaccggccatgtacatttctatggcaaattcaaggctctcaccatggaagggcgtgtattcggcgatgcttctatgaaggtagacgtgctcaacaccactttctccgtcaaagacagcatctacatcgagcccggcgggttgaccttccgcaacaaccgcattttcgacacgcaagggcatcaaggaagtatgagcggctatctgcactatcagcattttaagaacctggagtaccgtttcaatttcaatgtcaacgacatgctggtgatgaataccaaagaatcaccggactatcccttctacggcaccgtctacggtacgggaaatgccactattgccggtaatgcccaagatggcgttaacattgatgttgcaatgactaccaatcgcaacactacctttacctatataaaagataacgtatctacagcagtcagcaaccagttcatcaagtttgtggacaagacaccacgccgtgccgtacaagactctatccgcctttccgactacgaaattgcccaaaaggaaatcgaggaagaaagagagagcgacactgatatccggctgaatctcttgatagacgccactcccgacgctaccatgaagattatcatggaccctatcgctggcgactatatcagtggacggggaactggaaatatccgtactgagttcttcaataaaggagatgtaaagatgtttggcagttaccggataagccagggagtctataaattcagtctgcaagaggttatccgaaaggactttattatcagggatggaagttccattacattcaacggctcgccactggatgccactctggacataaaagcaggttatacggtcaactcagcatccttaaatgacctaatgcccaacgaggcaacctccggctacatcagccagacaaatgtaaaagtgaactgtatgatggaccttaccggacaattgacctcacctgatgtaaaattcgacatcgaactgcccaacgaacgcgatgaagtgcaggccattgtccgtaactatattcctaccgacgagcaaatgaacatgcagatactctatctgttggctatcggcaagttctataccccggaaaacttaggagccacccagaattcgaatatgatgtccagtgttgtttcatccaccctttccggacagttgaataacgctttatcgaacattctcgatgtcaataactggaacttcggcaccaatttcagtaccggtgaaagaggctggacagacatggagttcgagactatgctttcaggacaattattgaataaccgactacttatcaatggtaattttggttatcgtgataatccgatggcaaataccaattttgtgggagactttgaagcggaatggctcgtcaaccgttccggagacatccgcctgaaagcgtacaacgaaacgaacgaccgctactacacccggacaaatctgacaacacaaggtattggcattatcttcaaaaaggatttcaacaaatggagtgagctccttttctggaacagatggaaactcaagcggctgagaaaggaacaagaaataaagcaagataccctatccactgataaaataaacacagaacagcagatgcccgaggcacaatcaaaacggaaaagggagcaaaagtaagattgacgttcttactgtccacattgaaggttttagaataagcaaataggcccgaatacagcattttaaatggctacaccctttgtacctaaaggtgtagccatcactctacgatagtataggcattcaaggcaaagggtgtagccataaaaatacatcagaaaggcaatggcccgtccgcccccacacctccaaacgggttgtccgtctgtggcggaaaatcagcagccgatggaggtggcggtgttgccgtacttccgataggcgcattcatacgtgaaccaaatgtagctcctccaccctccgtcggaggtggaataaccatatcatcctcgggattctggaaacgggtgtactgtccgataaacctcagacgcacatcccccacggcaccgttacggtgctttgctatgatgatttccgccataccgcgcaagtcactgccatcggcagaagtataaatcttgtaatattcgggacggtggatgaagcacaccatatcggcatcctgctcgatggcaccggattcacgaaggtcgctcaactggggacgcttgccttcctcgccttcacggttctccacaccacggttcaactgcgacagagcgatgataggaatgttcagctccttggccaaacctttcaatgaacgcgaaatggtactaacttcttcctgacggctgccgaaagacattccgcttgcattcatcagctgaaggtagtcgatgatgataatcttcactccgtgctcacgtaccagacgccgtgccttcgtacggagttcgaataccgacaaagaaggcgtatcatccacataaagcggagcatccagcaagtcacgcagtttgtaatccaactgctgccattcatagtccgccaactgaccactcttgattttctcactcggaatctcgcacacgttggatatcaaacgattcaccagctgcacgttactcatttcaagcgagaacagcgctacgggattgcggaaattcacggcaatgtttttcgccatggaaagtacgaacgccgttttacccatggcaggacgggctgcaataatgatgaggtcggacttctgccatccggaagtcatcttgtccagcttggtatacccactttccaagccactcaaaccatcggtacgggcagcagctttctgaatcaaatcataggcttcggcaatgacaggattaatttgtgtataatccttcttcatgttctgctgggaaatctcgaacagttttccttcggcctcctgcatcaaatcgtccacatccagcgtctcgtcgaaagccttgctctggatattactggtaaaagtaatcaattcacgtgccaaagctttctgcgcaatgatacgtgcatgatattcgatgtgtgcagaagatgccaccttactgctaagttgggtaatatagaacgggccgcccacttcctccaattctccccgctttgaaagctgctccttcacggtgaggatatcgaccggcttctgattcacggccaaatcggtaatagcggaatatatcagctgatgtctatgctcatagaatgactccggacgaagaatttcacttaccagcgaataagcgtccttctcaatcatcaaggctcccaagactgcttcttccagctccggcgcttgcggctggatacgtccgtagtctgttacgggctgtggtgcctttcctttcggagtacgggatgttcttctttgttctgccactttaagaattaataattgaaaattaaaaattaaatgaacttcccttttagaaaggggaagcaaagataatgcaaaccgaatacataactttcatgcttgcatgaaaaagttatgttgaggtgcagcctatcttcgctcgtatggcaaagataagcgaatttatttataagcggtaaataaatcattgctaagttttcaatctactatgaacagaaatcactaactttgtcttcggaagctgcacttcatagcttccccttttaattttaaattattaattcttaattttcaacgccatgctgacttttccaaatgccaaaataaacctgggactgaatatcacagagaagcgtccggacggataccataatctggaaaccattttctatccggttcccatagaagatgctttggaaataaatatcttgaacgaaggaaaccgaaagttccgtctgcatcaggcaggtctggaaattgagggagaagcagagagcaacctggtagtgaaagcctacaagttgctggacgaccaattcaaccttcctccggtagacatccatctcttcaagcatattccctcgggagccggactgggtggcggttcggccgacgcagccttcatgctgaagcttctgaataataagtttgaactcggactgccggatgacactctggaagagtatgccgccaagctgggtgccgattgtgccttcttcatcaaaaaccgtccgacttacgcagaaggtatcggaaacatattttctccccttcccctctcactgaaaggatatcggatatggttggtgaagccggacattttcgtctctacacgggatgcctttgcaaaaataaaaccgcatcatccggaaatgtctctgaaagaaattgcccaacttcccgttgaagaatggaacggacgaatggtcaatgactttgaagaaagcgtattcccccaatttcccactatcggagaaatcaaggaagagatgtatcggcaaggagctgtatatgcctccatgagtggttcggggtcatctgtttacggattattcaaggaagatgccgtattgccggaagtggatttcggagaaaaagcttttgtatacaaaggccggttcactgatgtttaaaaatgcatcaaccaatatactgatttccggaaacaaaaacacaacaaggttgttcttacagaaaactcaaaacaaccttgattatgaaaaagttcaaattcggtattctggcaggactacttgtcttgctgtcagtgtccgcttttgcggaaggacgtcttcccgtaaatatacaaacagcttttcaaaagctctatcctcaagcaacggatgtggaatgggagcaaatggccagttgctacgtggcagaatttattgcagatggtcaggaagttgatgtctggttcaataaacaagcggagtgggtcatgactgaaacggatgtagagtcactggaaaaagtgccggctcccgtggcagaagcattcatgagcagtacaatggccggcatgaagttaagggacgtaagaatcatcacctttcccaaacatcccacagtgattataattgaggtggaacaatacaattccgatgaagaattccaactgttctatgctccggatggaaaactattacaaagcctcgatgtaacagaacttggaggagagatctatcccggactctttttcaatgattaatactgacgattggtgatttgtcgatggtatccattcatcaacaaatcaccaatcattcatcaccaatcattaatatacctctaccctatcagcaatacgcttcgctttgtcgcgcaacgtgtcaagatcactgtcaagaggtgcataacacagcactacacccatacggcggtttacgcgggtagtaggcttgccaaaaatacgcagataagtatcctcttcttttgtaacctcttccatgccacgataattgggacgttcctgactggctatcggagagaggatgacagcactggctcctatacgctcctgcttgatgccagggataggcagaccaagcaccgcacgacagtgcaattcaaactcattcagattctgggttccggccagggttaccatacccgtatcgtgcggacgtggagaaagttcggagaaatagacaccgttctcatggctgagaaagaattccactccccacaatccggcaccggtcaaggcacgggtcactttctctgccatatcctgcgcctcccttagatgggcagggtcaatatgggcaggctggaagctttcacgatagtccccacccttctgtacatggccgataggtgggcagaacaaggtcgggccattcttctgcgttacggtgagcaatgttatctcactgtcgaacttgatgaattcctcaatgataagttcttttatgtctccacggctaccattacagccatattcccaagcatgctccaattcgtcggcactctttacgagagactggcctttgccggaagaggacatcagcggtttcaccacgcatgggaaacctatcttttcagctgcaattttcagttcatccagagatttggcataaaaatatttagctgttttcagtcccaactctttagctgcaaggtcgcgtatagccttacggttcatagtaaagttcacagcgcgtgcactgggcaccacttgaatgccttctttctcgaaatcgtacagacgttccgtacggatagcctcgatttccggaacaatgatatccggctggtgtttgcgtaccacgcgttccaaagcatctccatcaagcatgctgaatacttcacattcatctgccacttgcatggcaggcgctccggcatacgaatcgcaggcgataatatactgacctttgcgttgggcggaaattacaaactccttgcccagttcaccagaacccaacaataaaatctttttcatcctatctatttatttactatttgacaattttcaatttactattcaacactatacaatcagacgatttactattcaccatccgctacccgattacagcacagccaatagtaaatagtaaatcgtctaatagtaaattcctttattggtgctgttctctcaacaaatcattcaccgtctttaccggattgaatgtagtcagaggcacttctacaaatacagtattccaatcactcatggcgccgttccacaaaccgggaagttcaagcgccttcaggtccttgccgttcttggacttataggagatgaaccccgtggctttatccacatacttcacaagattgaacttatgtcctttatagtcacgtacagcgcaaaccaaatccaccggattgaaatgggtacccttttcaaacatttccttcttttccggatcgtccatatcaatctgcgaactttccagaatctgcagagagatagtgccgtcactgttgtatgccaagaacggacctccacctggttcgcctacgttcttcaccataccgcagacgcgcatcggacggttcagtttttctttcaggtatatcaccagttcggcatcttccagattcttcgtctccgggttcttgcaatagagttgcttctgcaggaattgcaggatttcaagaatttgttcgtgtgtatatttcccgctttcaagcaactgcaaataggcaaataccttctgctgcaaagctaccagtacaccggcaatcagctttttatataatacggtgtcacccttcagtttgtcgggtaccacattgtcgatattctttatgaagataatatccgcatcaaggtcgttcaagttttcaattaatgcaccatgaccgcccggacggaacaaaagtttgccattgtcacggaacggtttgttttccatatcggcagcaatggtatcagtactcggtttctgttccgaaaaggtgatgttataatccaccccgtacttcttagcataagcggcagccttttcgtccaccaaagccttgaataaggcacggtgttcgggcgaaaccgtgaaatgtacattcactttaccatttttattgacagcatacaaggccccttctaccaaatgttcttccaacggcgtacggctaccgtcttcatacttatggaacttcagcagtcctttgggcagcgcaccataattcagtccggccccttcgagcaaggctgcaacaaccgccttgtagtttccggcagcaagcagagccgatatatcctttccggcagttctccggcaagcgatattcaggtcgtcatagaaggcaaacttctctatcttctcaaagaaagtcttttcaaagcctgtctggggggcatcataatctgctccaagaaactcaaacaagtttttgaacatacggctagcagcacccgaagccggtacaaacttcactaccaccttatcggtctgtgtatatgcctcccaagcgtccaggtatttcttctgttcatccgtatccggagccaatatccccttctctacagaagcagcggcagacagtttcaagtatggaaaacccttttcaaaacaagccaactgttcggctatttgttcttcggagatgcctttattttcgagcaactctttgtcttgcggtgttatcataatatcttgttttattaattcatgcccaaaaatacaaaaaaagcagaactgccgtcaagaaaatgaagaaaaaacttacctttgaagcataaaatacggacgattatggaaactgatgaatttttcactactaaagagaaagatttactcttctcgctctaccgcaaactgttgcaactttccggagaaaccctccagaagggggactgcaaaaagctgaaaacacatcttgtcaacactatacagaacaaccgtatccagcgtgatatattcggtttgaatcccgtcatcaaagatatgcaaacggctgtcatcgtagcggaagaaattggcatgaagcgcgcctccattctgggactcatgctgcacgactccgtgcgctgcggtacttgcaccgcccaagaagtagagcaaatttatggcgaggacgtggcaggcatcatccggggattgatacgtgtaaacgaactttattccaaaagccctaccatcgagtccgagaatttccgcaacttgttgctgactttcgccgaggacatgcgtgtcattctcattatgattgccgaccgcgtaaacatcatgcggcagataaaagattgcaagaacgatgaagcccgccggcaggtagccaacgaagcggcctatctctatgcgccccttgcccataagctgggtctgtataaattgaagtcggaactggaagacctctcgctgaaatataccgaaaaagaggtttactatcatatcaaggacaagctgaacgagacaaaggcatcacgcgacaagtacatcgcctctttcattgcaccggtacaaaagaaactggaagacgccggactaaagttccacattaaaggacgcaccaagtccatccactccatctaccaaaaaatgaagaagcagaaatgccccttcgaaggcgtgtatgacttgtttgccatccgcatcattctggactcttgcctggacaaggagaaactggaatgttggcaggcctactccatcgtaacagatatgtaccagcctaacccgaaacggctacgcgactggctgtccgtacctaaaagcaacggatatgagtcactgcacatcaccgtgatgggtcccgaaggcaaatgggtggaagtacaaatacgtaccgaacgcatggatgatattgccgaacgaggcctggccgcccattggcgatacaaaggagtgaaaggtgaatctggtcttgacgaatggctgacttccgtacgcgaagccttagagagctcggacagcaacggactggaaacgatggaccagttcaaactggatttgtacgaagacgaggtatttgtatttaccccgaaaggcgatttgttcaaacttgctaaaggctccaccgtgctcgattttgcttttcatattcacagcaaactaggttgcaaatgcatcggtgccaaagtgaacggcaaaaatgtacagttgaagcaaatgctgcatagcggtgaccaagtagagataatgacatcgaatacgcagacacccaagcaggactggctgaacatcgtaaccacctctaaggcgcgtaccaaaatacgccaggcgttgaaggaaatggctgcacgccagcacgccttcgccaaggaaaccctggaacgcaagttcaagaaccggaaaatagagtatgatgaaggaaccatgatgcgcctcatcaagcgccttggcttcaaggtagtgacagacttctaccaggctattgccgatgaagtgctggatgtcaacgagattatagacaaatatcttgaacagcaaaaacgggaaaacgacacacgtgacgatattgtctaccgcagtgctgaaggctataaccttcaacaaggcataccggaagagataggtactaaagaagatgtactggtcattgaccaaaatctgaaaggattagatttcaagttggcacgctgctgcaatcccatctatggagatgatgtattcggctttgtcagtgtaacgggaggtatcaagatacaccgttgcgattgtcccaatgccagtgatttgcactcacgtttcggctaccgtatcgtgaaagcacgctgggccggaaagtcacaaggtacacagtaccccatcaccctgcgcgtagtgggacacgatgacatcggcatcgtgaccaacatcacttccatcatttccaaagaaacgggtattaccttgagaagcatcggtattgactcgcatgacgggctgttttccggaacgctgaccatcatggtaagcgacacgggacatttggaagcacttgtcaaaaaactaaggacggtaaagggagtgaaacaagtttcaaggaattaaatgacaactataatccatgaagtacgactttaaaaagcagttgcgcagtttcggatatgcctggaaaggtatccggtgctgcataggaaaagaacagaacctgagcttccatctgattgccacggtggttacggtgattgccggattcttattggagattacccggatcgattggatgattgttattctttgcatcggagtggtgatagcagctgagctgttcaataccgccattgagaagctggtcgacctggtgtctccccaacagcatcccgtggcagggcaagtaaaagacatagccgccggagcagtactggtatgtgctgcaacggcggccattataggattgattgtatttatcccttacctcacccgctttttcttataataaggataggtcagcagcacaaagaaaaatacggtaagcatagcggcaacagatgccacatggtatatctgtactttgtccatcaggtggcaagccacagccatgcccaccagcagccctgcctccataaacaaatggcaagtggtgtttgccgttccacgctggcagtggtgcgacaatttgacaaacatcttcatgaacgggactgtaatgaacaccagtacagccaatgccgccaatgaccaataatcgcccacaaacatcagcggtagcaatgctcccggtacaaaagcaatcagcagcatattgatggcaggtacccatgcacgcggcaataagaaacggtccatattgcacagcgacacgcctatcggagcacggaaagccacatataccctcgatgcgaaaaatatgctggccagtccggccgctacggacagataggtcaccatacggaaaccatacatcttatacattccaatgcccaacataacacccaccagcatgcccaagcatgcagcccatgcatataccatgtttcctgcactgcggcgtgtggaagtcgttatgtcgatggccaccgtaatgcccgctgtggttgccagcccgaaacatactccctgcacagcggcaagcagcagaaatttcgtataaccatccacaaaggcatatcccagaacagccgccagcataatgagtgtggagtaaaggagcacgtgcttccttttatattcatcgaccagataggcatgaaaaggaccgacagcaaacatggccaccgcaaaaaccagaaacatgctgcccgcctgtccgacggaaacacccaactgctctcccatcacaaaagggagcaaaggaaaaagcatatagacggatatgtacagcaacagatttgccgtacacatccgccaaaaattgagtgtcataagtttgttagtactgttctttctcattcgggaaatctaagttcttcacatcagatacataacggctgatggcatccgtcatcactgtatgcaggtcagcatagcgacgcaagaaacgaggacggaaaccgttattcatacccagcatatcctgaaccaccaacacctggccgtccacatcgccaccggcaccgatgccgataacgggtatagtcaactcactggccactcgggcagccaatgcggcgggaatcttctccaataccagtccgaagcatccggcttcttccaacaaatgcgcatcgcgtaccagtttctcagcttcagcatcatccttggcacggacagtatatgttccatacttattgatggattggggcatcagtccgagatgtcccatgataggaataccggcgctaaggatacgtttcaccgtaccgatgatttcctcgcctccctccagtttgagggcgtcggcatggctttctttcataatacggatagcggaagccaatccctccagttcgttgccctgataagaaccgaaaggcatgtcgacgatgaccatagcacgcttcacaccgcgaaccacggatttgccatgataaatcatctggtcgagcgtgatgggaagcgtggtgacattgcctgccattacattggaagcggaatctcccaccagaatcacgtctacaccggcaccgtctacaatctgcgccatagtatagtcataagatgtcaacattgatatcttttcgcctctttgcttcatttcaacaaggcgatgtgtagtcactttacgagtgtcgtctgaaatataacccatgatagtatttacaatttggcaatttacaattactcaatttaattttcggcgcaaaggtaatcctttttctgattacttgtacaattgagttaatttatcgtaagtgaaaccctgaaagtcatccaatacataatgacacaacgaggctatgtcttcacgggaattggtggttgccaaccctataacggtagctcctgaagccatgccggctttcagcccgttgaaggaatcctcgaatacatatgtggtgtcgggagttgtgccgaaaacctccatacccaacagaaaacaatccggtgcaggcttggaagccgtaaacatctcggccgtaaggatacggtcgaaaagagtctttatttcgggatgaacccgatagacagctgccatcttcgcttcgttggagctggtcactacggcagtcttcacctcattccggtgtaggtcggcaatgaagtcaagcactccgggaataaagtcgaatgacatttcctgttcaaagcggttcaaccgttctgtaatttcagtctgctccttcaccatgcccggaaaaaaggtgtcataaatatagaccagcgtctggcccttcactttaccttcaatatcatccatacccaaatactgctttcccatttcatgccagaagtgactgtactgtgtctccgtgtctaccaccacgccgtcgaaatcaaaaagtacggcggttgcttttgttgtgtccataaactttcttttacctaaatctgttaataccaaaacactatagtgcacaaaggtgagaataatctgcgaaccaaacaaatatttcttatctttgcactccttaattgactcatatcaaatgaacaacccgcatatattaggaaccgagcgcattggcaaactgcttgtgcagtattccattccggccattataggcatgacgattacttcgttgtacaacatcatcgacagcattttcattggccatggcgtaggtcccatgggcattgccggacttgccatcaccttccctctgatgaatctggtcgtagctttctgtacgatggtatcggcaggcggctctaccatttcatccatccggctgggacagaaagacctggacggagctaccgaagtcctgggaaacacactgatgttctgcctggtcaatgcattcatattcggcggcatctcattcatattcctggatgatattctgcgcttcttcggtgccagcaatgatacgttgccatatgcccgcgacttcatgcaggtgatattactgggtacccccgtcacttataccatgattggcctgaacaatatcatgcgtgccacgggatatcccaagaaagcgatgcttacgtctatggtaacggtagtctgtaacataatcctcgctcccattttcatcttccaatttgactggggaatacggggagctgcaacggcaacggtcatctcgcagttcatcggcatggtgtgggtagtaagccatttcctgcaaaagacaagtgtggtacgtctgcaacgggggttctggaagatgaaaaaacgcatcatcagcagtatattatccatcggtatgtcaccgttcctaatgaatgttacggcatgtgtcattgtgattatcgtaaacaacagcctccaacagtacggaggcgatatggccatcggggcatatggcattatcaaccggctgctggtactctatgtaatgattgtattggggttgacgatgggaatgcaaccgattgtaggctataacttcggtgcgcaaaaacacgaccgtgtgaaggctaccctgcgtctgaccatcattgccggagtatgtatcaccagtacaggtttccttatctgcgaattgttcccccatgccatatctgccatctttaccagtgatgaagagttgatagatattgcttccagaggcgtgcgcattgccgtagccatattcccgctggtaggcgcacagattgtcatcggcaatttcttccaaagcatcgggaaagcgaaaatcagtatcttcttatcgctgacacgccaattactgtatctgttgccgggactactgatattcccgcattactttgggctggacggcatctggatatgtatgccggtatcggacttctttgcttttgtaacggctgttatagctttatggatatataatacccgattatctgtcaagagtagatttacgaaagattaacggtggatcccggaaaacacatcatccatacaccccaaacgcatgatgtgtttaccttgagcaggccatccaagtgggaaaatatcttattcactcttgatgctctttaccggattttcgttggcaacatgccatgatttcatcactacacatcccacgataaatgcaagcaacaaaaagccgatactgatatatccgacgataggcagtagtaccacatcactaaactgactgatccagatttgccctacctcataagctccaagtgttccaagcactacagacggtatggcaatccaaagcacatcacgcgacagcaatcgcaatataccggatgtttccgctccattcaccttacgaatggcaatctctttggaacgtaaacgtatttcatcatccacatatcccaccagccccattaaaatgataaaaagaatggtgaaagatgcccataaagtgacatcgcggaagacacgtacagattcggcataattgcccaacatttgctccatagaacggaacacaaggtcatcttgtggatatagacggctcatttcctcattcagtcggcgcaggttgtcatcaaacggttctttaagacgggcttccagacaaaatgcggtaccttcaaaccattctatcataacggcttcactgtcgttggtacagccgacaaatgcaaaactatccaacaaacctaccaccgtaccataatcattcacctgcttgccaatggggctgtccgtccaatgcattttctcacagaacgtgctgttgaccagcagttggtgtttccctgtgaggttatgtccctctttcaatttcaaaccgataaaaggcaagtagtcactatcgaaccacgaattacgcggatagaacatctcgttgccttgagcgtcaagtatcgggcgattggctccaaagcccgttatagagcgttcggccgaggcaaccgcctctacatagggcaagttacgaagttgtgtacgtaacagatctgcattcacttttctctggaagatagacactacacgttccggtcgccaaccacggtcgcgccctaccatatagcggtattgcaagaacaccatcagcatcatacctataatgaatgctgcacccataaactgtacgaagagcaatacccgcttccatcccctgcggccggaagtgtaacgcctgaatacttgcgtcacgggaatacgggcaaagagcatggcaggtaagcatcctccaaaaacaaacaagaccgccactaccgccaaaggcgcatataaatgctgccaatcgaacaatacggcaagagggactgccgccaactcctccatccgctcatggaagacataaaccaatattccgactaccaacaatgccgcacttattactatcgccgtttccaccagaaacatacagaagatactgccacctgatgcaccactacatttatgtacgcctatcgctttggcacgttgtgtcaacgaagaaatggaaatcaatacataattcaacgtcgtggtgaaaagtaacacagcacccaagaaaaacataatccaaaccattttgcggacttgcgcttcacccagatgcacactgcggataggtacaatatggaccgacagttccagcccgctatccgatggcaagtgccgtgcgacagccgctgatatccgttcgttcaaccaatcggcatcttgcggactgcgtaaccgaacgaaaccgtcataattcccaccactctgccatcccattccccactgcgtgtacttctctatattcgagaaagacacaactgcttcgggacgcttatacaaagaagtattcaaaggaacatcccgaaaaatacctttaacaagcaaagtagcttcatgcccccagaaatcgtatgacacagtcttacctatgggattttcatcaccaaatacctgccgtactgccgtttctgaaaggaaaactacatctggattcgctaaatcctgcggatttccttttactacatccaaaccgagaacagaaaaatagagcgtatcagcaatcactgtcttcaattccaacggacggttacccaacttataatcgtcatcgaatagtgaacaactgaccgtagccccttgcaccttatctgaaaattctttagctataatgccaggaatcggaataatggtgtagaaactctctcctccttccaatacaccattcttcatccaacccgtcttcacaatataaaggttatccggatcatgataaaagctatcaaaattcaactcgaatgcaatccgcgcaaataggaatacggacatcaacagtcccaatgctaacgatacgattttaatggcattggtcccctgtctatgcaataaactttgcaatgtataataaatgtgactactcatcataatttcctgaagttattctttattcactcttgatactgtctaccggattctcattggcaatccgccatgccttgaatactacacaaccgatgatgagcaatagtacaatgcatgcaataagcaagaatccgcagataccaaaatccactccctccacaaactgctctatccagacaccgcctatataccaggctcccagccctccaagaaaaacggccggcaaggatatccagaatatatccttcgagaaaagccggagaatggatgacgcttccgcaccattcactttacggatggcaatttccttgctgcggcgttgtatctcgtcattgatgtagccaatcaaccccattaacgtaacaaaaaggatggttatggcagccagtaaagctgcattacggaaatccgtgacggtactgttctggtcgtcaatgaccttttggaacgaggaaaatacaatgtcacgggtgggaaacagcttttccatgtcttcattcaaacgcttgaggttatcgtcaaaaggctctttcagacgtaattggatgtttccggaaaatcggtcaagataagttgcatacataggttgcaccgccacataagcggcattggatgtggcaaagtctttcagtacacctacaatattgcccgctatgcgatcgccgttgcgcacttgcctgcctatcggtttatcttcccaatgcatcattttcaaaaatgtttcattgaccaatatctgcccaggagcatccatattcttgccttccgcaaattccaacttcataaacggggcatagtccttgccaaattccacccaacgcatgctcatccactgcccgttatcagtcgtaaccccttctccgctcaatccgtctgtaagaagattactgctacaagctccatcttccacataaggcaaagaaagcatcacactacgattggcatcgctttccgcatccgagtcaaaggatacgcccgaagcataagccacccggtggtaatcgaatccacgttctttattggtgatgtaatggctctgcataagcaccagccccaacaagccgaaaataaaggaggtaccggcaaactgcacaaacaagagcggacgtttccagcctttcttgccttcggtgtaccggcggaaaacctgcgtcaccggaatgcgggcaaaaagctgcccgggcaacatgccgcctatcataaacaaaatgactatcactgaaagcggtgcccaaatgttttcccaagagaaaagaccggcaagactaacgtcgagcatgtcctccaacggctcacggaaattaaatagaagcagcgctacaagcagcaaggaaaaaagcatgatgactccggtctcccataagaacataccgaaaatagttcccgtatttgccccactacatttatgtacgcctatagctttggcacgacggttcatggctgagatggaaataagcacataattcatcgccacaataaaaagtatggcggttcccagcgtcaacagaatccataccatacgcatggtactgataccaaattccatacggtagtcccttatcggaaccagactgataaatacatcatcgctcttgcgcacctgcccggcaagtttctctattcgggtgttcacatcgtccagttgcacccccgggcgcagacggacaaaggacatatagctgtctccacctccccatccccagtatccccaatgatgcttgaaggaggtagccagagacatcacgacaccacttccatagaaactggagttttcgggaaaatcttcaaaaatgcccttcacggtcattggcatctgtttgttatagaccaccgtctgcccgatgggattcttatcggcaaacatgctgccggccagctccctgctgatgaagaccacctccggattattcagctcgcgagggtctccactgacaacatcaatgcccatagtggcaaagaaacaagaatcggccgtcatggcattggtctggaaacggcgttcattggcaaaccaagccgaattgctccaccattgctgggtgacggtaacactctccacctcgtcaggcaggttttcggcaatggtaccagccaccggtccaagagttatatgcgaaggatgatactcgttgttgtaataccatactgttttgacaagacacaaacgttcatggtccttgtagcaggtatcataattgagctcgaatgcctgacgggaaaaaatgaggatactgactgccaaccccagtcccagggaaacaatcttgatgaggttggagccttttcctcgtatcaatgtctggagagtgtaatatagttgtctcatggaagttgttttaaaagtccgttacaaatcctgtgctgccacacttgccaccacactaccgtcgaaaagatgtatcgtgcggtgtgcaaacgaggcgtcgtgctggctgtgggtcaccataataatcgtagtaccctctttattcagttctgtcaacagattcatcacctcagctccgttcttggagtccaagttaccggtaggctcatcggcgagtatcagcttgggattggttacgaccgcacgggctatcgccacacgctgctgctgaccgccggaaagctgttgcgggaagtgtttggcacggtggctgatgttcatccgcttcagaatatcctctaccatgcgtttgcgctcacttgccttcacgccgaggtacgtaaggggaagttccacattctcgtagacgttcagttcgtctatcaggttgaagctctggaacacgaatcccagtttccccttacgtacgcgtgtacgttccttttctttcaagtccgccacttcctggccgagtagcttgtaactgccctcagtaggattgtccagcagtcccagaatattcagcaaggtggatttgccgcaaccggacggccccataatggctacaaactctccctcctttacatcgaggtttacgtgattcaatgctaccgtctctacttccgaagtacggaatactttgctgatgttgttaatctcaatcatgatatttaatgttttaatattgttttattcgctcttaatactattcaccggattctcgttcgctatccgccaggacttccaaagtacgcaggctacgataatcaccaaattgaccatcactaccagtacgtatactgcccaactgatgggaatacgctccgcaaactgttccatccacattccgttgacataccatgccaataccgtaccgatgacaactgccggagccgccaccacaagtatattcctcgacagcatttccaagataccggaagcctctgccccgttcactttacggatggcaatctccttactgcggcggcgcacctcgtcggtagtatacccaatcagccccatcagcatgatgaagaacatggtcactgccgccatcaaagtggcattgcggaatacacggacagaattatagctgttctctatccttttctcataaccggtaaagtcaatggtctggtcatggaaagcctcggctacatcgtggttcaacttctgcagattttcggtaaagggttctttcaaacgaacatgtaccgttccataaaaattcttgttcccacgggctatgaaaggcatcttctcggttctgaaactctctatctggaaatccttcaactgccctacgaccttgaatgtattcccttcggtatataccgtacggcccacgacgtcgtctccccaacgcatcatctcggcaaaggtctcgttcaccacgacttcctctttatcgcgcgccatacgtcccgtcttcatagtcatgcccatcaaagcaggaaagtcctcgcgcatgaaataagaagaacggcaagagaaaagtgcctgcccgctctcactatgaatcatcgaaccgctatatccgctaatgggcgtactgttggcgctggacaccgcttccacgtagggcaatcccttgaagaactgataagccgcgtcacgcgtcgcttcattatcccagtaggcattgcctatggctatctgcttgggattataccccatatcctttttcagtacatactgatattgcgacatcaccacacacatcaatccactaatgaatgccacgcctgcaaactggacaaacagcaacggacgcttccacccctttttcccctcggtatagcggcggaacacctgcgacacgggaatacgcgcaaagagccggcccggcaacacgcctcccactataaacagcagaagcactaccgacaacggtacccagatacgctccggagccaacaaggtggagagctttacaacgaccgtgtcttccacaaaatcgcggaagttgagcattatcaacgccatcagcagcaatgccgccacaatgatgatacccgtttccagcaaaaacatgctgaaaaccgtgccaccgctcgcaccgctgcatttatgtacgcctaccgacttggcgcggtagctcaaagaagaaatggaaatcagcacatagttcaacgccgcaatgaaaagaatggcaaaaccaagaatgctcatgatgacacgcatccgctgcacatcatcataattgcggtatgtatcacggatgggctgcacaaaagccgtgtagccgtactctttcttatcttctgccgggcgatatttgtctatcatggcatcaatacgcgcattgacaacagatttgtcggcaccgggacgaaaacggataaactctacccaactgtctcccccgctccacgagtagttattccagttgcggctccacaaggtaggcatcgagataaccgcttccggattgattgtggcgttctcaggcaaattggcatagattcccttcaccgtcaggtcaaactgatggtcataattaagcgttttccctataggattctcctcaccgaacactttccttgcaaagcgttcactcaagaaaataatatccttctgcaccaagtccttttcgggattcccgttcaggacgtcgatacccatggtacggaagaacagcgaatcggctgcaatcttcctgtcatcaagacgcacgcttccattgtaaagaggagcagataccatagacgtgctcaaacttactgccgactccacctctttggggaagttctccaaaatggcccctgccacgggaccgcaattccactcctgaggctcaaacttctctcctttcaccgagaatatcgaccatacctgatacaagttatcataatccttgaagcaagtgtcaaaactctgttcatatgccacgcgggagaaaagcagaatactcatcgtcaatcccaatcccaaagaaatgaccttgatgatattcgaaccgcgtccccgcagtaaagtctgaattacataatagatttgtttcattccgtttatcgtttattagatttattttcttgcttttcatattgcagaaagcgtgccaaagaatacacaaacctgattatcagcacatatcgtatttcaaaagaagacaaaggtgtctaatttttagacactcccgtctaaaaattagacagaggccgaatctctgttcagcctcatagaacaaaaaaaagggaaattagaaaagaatccataagaatgaaaactttacctttgcccacagttttctaaagatagagtataaacgtaaaatgaagcacctgcacatgaaattccccaaactcttatatccttcattcctatgcctgcttatagccggctgcgacatgatagattatcacccttacgatgtacacatcagcggtgaaaccgatgtcaatgcccacaacattgcccaaatagagcagaactgccagaacaagacaacaatccggttcgtaacaatgggtgactcccagcgctggtatgacgagaccgacgactttgtaagccacctcaacaagcgggacgacatagatttcgtcattcatggcggagacgtcagtgacttcggtgtaacagacgagttcctttggcaacgggacattatgaacaaactcaagataccctatgtggtacttctcggcaatcacgactgcctgggcacgggcgaagagacttatcgtgcaatattcggagaccccaatttctccttcattgcaggacgggtaaagtttgtctgcctgaataccaacgccatcgaatttgactactcccgccccattcccgacttcgagtttcttgccgcacagatacgcgaccgtgaagaggaattcgataaaaccgttgtgtccatgcatatacgcccgttctgcaacgagttcaacaataatgtggcacacgtattccagcgttacatcaaggaatttcccggactgcagttctgtacatccgcacacgaacaccatcgcttcgagaaagacctctttgaagatgggataatgtattacatgagcgactgcatgaagaaccgcaattactatatattcaccataacccccgacggatatgaacgcgaagtggcatattattaatcacctggcatgcgccgtcgtcttcttgtcggtatgctctttttctgctttttcacaagagagagataccatcttcatcatagaacacgatactgtatggatggacccgcaaccggatgccgtcattgaaagccgaaccagggagaaccgttatgaccgccgcgtacaccgctaccgcaggcattgggaggccttgattccgacgcacaccaaaattcagtttgccggcaatatggggttgctgtcattcggtaccggatgggattacggcagaagaaaccaatgggaaacagacgtattcttcggagtattgcccaaatatgactccaaacgtaccaagctgacattcactgtcaagcagaactaccttccctggagcctgcaaataaaacagagccgtttttctgtagaaccgctggcttgcggcatgtatctgaacacggtattcggcgatgagttctgggtcaatgagccggaacgctaccctaaaggatattatggtttctcctccaaggtacgcatccatgtattcttaggacagcgcatcacttacgacatcgacccacaacgacggttcacggccaaagaaatcactttcttctatgaaataagtacatgtgacctatatgtagtcagcgccttcaccaacaagtatctgaaacccaaggattatctgagcttgtcatttggcatcaaactgcaactgctataaattttttcagtaccgccatgagctcttactgaagttgctacaaactaatttctgttttacttaaatctattcgtcccacaatcgttatattatcgtccgacagttgttgaattatcgtccgacagctgtcggacgataattcaacaactgtcaaacagccctccacgtaaacagaaattaaacctgcgtaaacgtttcgttttgcgggagttccttctatctttccccgtaacctattgtattataaagcgatgtgtcgttttattcaatatatcgttttatacgcttcgttctgtgccccgtaaaatgctgcacgacaaagataattatttcctctttacggtgtattctccgaaagaaagaagtactcttttttgccggataatacgggttttattaacttgcgcacaaattaaccactaatcactaaccattaatcattgattccatgaaataccaagttgccattatcggtggaggtcctgcgggatatactgctgccgaagctgccggaaaagcaggattgagtgtcgtactatttgagaagcagagtctcggtggagtgtgcctgaatgaagggtgtatccctaccaagaccttgttgtattcggccaagacctatgacggagcccgccatgcttcgaagtatgcggtcagtgtgcccgaagtatcgtttgatttgcccaagattattgcccgcaagcagaaggtagtgcgcaagctggtattgggagtcaaaggaaagctgactgcccatggtgtgacgattgtcagtggagaggccacagtgacggacaagaatcatgtggagtgcggcggagaaacctacgaatgcgagaacctgctgctctgcaccggttccgaaacctttgtccctgccattcccggcatagacaaagtgtcctattggactcatcgtgatgcgctggataacaaggaactgcccgcttcgcttgccatcatcggcggcggtgtcatcggtatggagttcgcttctttcttcaacagcctgggagtgcaggtaactgtcgtcgagatgctggacgagatactgggaggcggtatggaccgagagctggcgggtatgctccgtgcagagtacgccaagcggggaatcaagttcatgctgagtgcaaaagtagtgtctgtcatgccggatactgccgaagcttcttcccttatccaggtgaattatgaaacagccgacggtcccggttccgtcgttgccgaacggcttctgatgagtgtcgggcgccgtccggtaatgaaaggcttcggattggagaatctgggcttggaaagaacggagcgcggaaatgtctttgtcaacggacagatgcagacctccgttcccggagtatatgcttgcggtgacttgacgggatattccttgctggcgcatacagccgttcgcgaggcggaagtagccatacattccatcattggcaagaaggatgccatgagctaccgtgccatccccggcgtggtatataccaatcccgaaatagccggtgtgggcgagacggaagaatcccttcagaagaaaggcgtagcctaccgtgcagtgaagctgccgatggcgtacagcggtcgtttcgtcgccgagaacgaaggtgtgaacggtgtctgcaagttactgttgggtggcgacgataccgtattgggggcacatgttttgggtaatcccgcttcggaaatcatcacgttggcaggcatggccattgagctgaaacttactgccgatgaatggaagaagattgtctttccgcaccccacggtgggagagatattcaaggaggcattgtagaacccatgactattgtttcatataaacataaaagatgaaaaccgtaaagctaatcacctgcgacgatgcctttcaggcacatgttattcagggtgccttgaagaatgagggcattgcgtctgttttgcataatgaaaacatgtcttccgtgatgcgcggatatgtccgtgatgtcacgggagtggatatatttgtctatgaggacgaatatgacaatgccctccgtctgcttgaacggaaccagatgattccggaacagttgaggtactgcccccattgcggttcggatgagattaagtttgtgctgaagaagagccatcgggtgcgtgctgtggtggctgctgttattgcggcattgtcggccgcacctccgggcactgagcattgggagtatgtatgcaggaagtgcggcactcattttgagaagccggtggcgaaaggaacaattgaagaataatcaggtgtttattcttttaaccgcttttcaatccagtcccggtttttacgtcccaatcggctttccgcaaaatccaggaaagccgatgtgtctgttatatgggcttggatgacacctgccagaaagttgaagaaaggttcttcacccacccggacaagcaggtcggcgagtagtactgaccctttcctatagagggcaagatgcgcttcgcggtcgttgcggtcaataccccagataggacggatatggcgtgtttccttacgataggcgtcgatgtaagcggcataggctttctcgccgcgggcgtggcgtatgtattgcaaagcactgaattcggcaaaagattcgttcagccagtcgtgccaggattccaccggagccttgttccaccagaagtggccgatttcgtgggcggtgttcttgagtacatattcattgaatgttcgtgaactgagcataatgaaatttttacggctgtaccctcctgaggtgccggaagctgaaagcaggaatttcatgtaaatatcctcatctcccgcaattttataaaggcgtcggaagaatttcaaggcattgtggcaacattgaagtgccgagtctgcaccggcatccgggaagtctgtatagataagttcaatggtagttccgttatcattgatgcggcggcttttcagcatgggtgaagccaggataacattgtcgaaattctcccaaggttgctccatttcccacatcccttcttctgtatgggaaataatacctgagccgctcaccgtataaccgtcagtgatgccgattcgtaagtgcgaataatctgcccggttaccgttgcagacaggataccatcccgtatagtaaccaagttcaatccaatggtcattgaatgattttgcagggccctgcacttcctgcatgtagagtgtgtaacgggtatttatgcggcagcggtcatcggctcctgccggccggtagagggtcaaggtccgtccgtcgggaatgaattgggcaggtgctggggcaagcgtatcgaaacggtaggttatctcccggctgttgtggcgtagtgtgtcgatacgggcatggcgccatagtaccaacgagattgagtcactgtcctggaaatcaacttcaaacgaaccgcctacttcgacctgtcggttcggtacatcaatctgtacggttaagtcataactgacaatgcgcggagattcttgtgcccgaagcatgggggagaaaaggaggcatattgtaaagctggcaattgtaagttgtagtttcatggtacatcaattttagagtgatagtaactgggagattttgcctatgtaaaagtagtatttttaaaggaatattaagatggatggctggatataatttatgaaaagactacctggttattgttcatttgtaagattgtcgtacttttgcctttaaagataaatatatttatgaaaaggatattgttgctgttaattttatccgtctgcctgctcccattgtggtcccaagagacggtaactccggtgaagccgctctctgcgcggattgatgcgttgatagaacacaaacttcccgcaggctctaatgtggccatttcggtctatgacctgactgccggcaagcccttgtacggctatcaggcggacaagctttcccgtcccgcttccaccatgaagctgctgaccaccattaccgccctttcccgtcccgaagccgacgagccgttccgtacggaagtgtggtatcagggaaccattgagcgcgataccttgcaggggaatatgtatgtgataggcggttacgacccggagtttgatgaagaggcattggattccctggtggctgccgtggcccgtttccccttctctgtcatcaaaggcaaggtgtatggagatgtctccatgaaagactccttgtactggggcagcggctggttgtgggatgatactccctattccttccagccctacctctcaccgctgatgctgaataaaggagtggtgaaggttaccgccacacccggcgaacggggcgacagcgcacgccttgaatgcactcccgcctcttcctattatacactgacgaacaagacccaaagccgtaccccttctgccggacgtttccgtgtgtcgcgcgactggctggtgaacgggaacaacatcaccgtgacgggcaacgtcgatgcccgccgtgcaggtacggtcaatatattttcttcgcaggacttcttcatgcatacctttatggaacggttgcaggcacgaggcatccggtgcattccggcggcagaagcggaagtctcttacctcttcggcgagttccggcaagacagtctttccgtgcggatggcttcctatgaaacttccgtgcaggatgtggtgaaacagataatgaaggagagcgataatctcaatgccgaagccatgctctgccggttgggtgtgcagagcagcagaaagaagcgtgtctctgccgaggacgggctttctgccatccgcatgctgataaaagagatgggatataaccccgataggtataatctggcagatggttgcggcctttccaattacaactacatttcaccggaactcttggtttctttcctgcgatatgcctactcgcgtacggatgttttccagaaactttataaggctttgcccattggcggcgtggacggtacactggagttccgcatgaagaaaggcaccctttcccacagaaatgtacatgccaagacgggttcctttaccgccatcaactgcctggccggctaccttaaagcccgcaacggacacgagatagcctttgccatcatgaaccagaatgcactgtcgggcagggaagcacgcgctttccaggatgcggtgtgtgatgaagtgatacgttgaggtttagccatcgtaaagttgacctttagcgtcgtaaagttaaggtttagcttcctaatgcagacctttacggagtgagccccaagagtaggggaaatcattcctctttcgtattgcggtagcgtgccggagacatacccagataagacttcacatacttcccgaagaaagactggttggggaaattaaattcttctgcaatctccttgatggacttgtccgaatgcttcagccggtacttgatgtgctcgatggcactttcgttaatcaagtcaagcggtgtacgtccgcacgcttgtttgataaccttcgaaaagtgtttggggctgtagcagagtgcatcggcataatatcctacagaacggtgtatgccgttgtctttggacaacatctctataaatttacacaggatatagtcggactgtttgatgctttcttttgtatcggctgtcattgctgaagggttcacttctttgttgaggtgtcccaacatctcacagaaaatggcagaaaacaagtgttgcatcacttccctatgatagggatgaggctcgtcgtttatctttgccataagcagttcccggtagaatttgaagatttccttgtctccttcctccccgacagattttatgggattgttgtggatatgcataacggtattccatgtatccttctccatcttgaccacgcgttgtaggaactgtgtggagaatgcggcaagccttatcttgtgctttgggcttaccatcgcgtggctgataatggtattgggaaggccgagcagtaagtcgcctgcttccagttggtaggttttgtagttgacgtccaactggatacagccttctagacagatagcgataaggaagcatcctaatcttattgtatcttcattgtaggggcttccctccagactgttgattatgacaaagtcattgtctacatagtcaaggacatgttcgctgttcttaaagtccgcgatttctacgatttttatgttccctttctccatattcttcctttttcgttttgcaaagttggtgaataatgggaaatatggaatgttccattatgcggctttcttgttctatatgtcatttatagacaattcattagccttaaaaaagatgaatgtcgaaaaagggatatccttggagtgtaattggtcattatggcgttgttcctttctcctacttttgccaccagttttaacaaaaatacaatgagaaagagtatgattacattaaacaggaaatggatacggctgatagggattgtcggttgtacaatgtgtttggcatcttgcaagcaggcaacggatgcttccggaatgaaaccttcttacgctaccatgaaagtggaggcgacagacaaagagctttccacttcgtattcggcaacgatacgcggacggcaggacatagatatctatccgcaagtgtcgggtaccattgagaagctttgtgtgactgaggggcagaaggtgcgccgcggacagtcgcttttcattatcgaccaagtgccctacaaggctgccctcaaaacggccgtggccaatgtggaggctgcacgcgctgcactggctactgctgcactgacttacaatagcaacaaggaactgtatgcgcagaaagtggtttcggaatttagtctgaagactgccgagaacgcctatcttaccgccaaggcacagctctcgcaggccgaagcccaggagataagtgcgcgcaacaacctctcctatacggaagtgaagagtcccagcgacggtgtggtgggggcattgccctaccgtgcaggagcattggtcagccccagcctgccgcagccgttgacaacggtcagtgacaacagcgacatgtacgtttacttttccatgaccgaaaaccagttgcttgccctgacccgccaatacggaagcatggacgaggcgttgaagaacatgcctcaagcggaactgagactgaacgacaattccgtctatgacaagaaaggaaccatcgagtccatcagtggcgtcattgaccgtcagacgggtacggtagtggcacgtgtggtatttcccaatgaatcgcgcctgctccacagtggggcgtcgggcacggtggtggtgcctaccacttataagaactgtattgtgattccgcaagaggccaccgtgcagttgcaggacaagacagtggtatataaggtagtggatggcaaggccgtttctgccttgattaccgtggccggaataaatgacggacgcgaatacgtagtgctggacggactggaagtcggcgacgagattgtttccaccggtgccggactgctgcgcgaagggacacaggtgaaataatgaactgctatttatcaactatcaatgacccattaagatgaaaggaaatatatttataaagcggccggtgatggctatctccatctccgtactgattctggtgatagggcttatctcgctctttacgctgccggtggaacagtatcctgatattgcacctcccacggtgtacgtcagcgccaactacaccggtgccgacgccgaagccgtattgaacagtgtcatcatgccgttggaagagagtatcaacggtgtggagaacatgatgtacatcagctctaccgccaccaatgccggttctgccaccatacaggtctacttcaagcagggcacggaccccgacatggctgcggtgaacgtacagaaccgcgtatccaaggcgcagggactgctgcctgccgaagtgacgaaaatcggtgtgactacccagaagcgccagaccagcttcctgcaaatcggtgctttggtaagcaccgacggacgctacgaccagactttcctagccaattacctcgatatcaacgtgattccgcagattaagcgtatcgaaggtgtgggtgatgtaatggagctgggcgatacatacagcatgcgtatctggctgaaaccggaacggatggcgcagtatggactggttccttcggatgtgaccgccgtattgggcgagcagaacatcgaggcgcctaccggttcgctgggcgagagttctaagaacgtattccagtttacgatgaaatatcgcggacgcctgaaaagtgtggaggaattccagaatacggtggtacgctcgcagagcgacggttccgtgcttcgtctgaaagatgtggcggatgtggagctgggtacgttgacttacagtttccgcagtgagatggacagcaagccggctgtacttttcatgatgttccagacggcaggctccaacgcaaccgccgtcaacaagcagattactgcacagatagacgagatgaggaagagcctgcccgaagggacggagtttgtgacgatgatgagctccaacgacttcctcttcgcttccatacacaatgtggtggagacgctggtgattgccattatcctggtaatcctggtggtgtacttcttcttgcaggacctcaagagtacgctcataccgtccatctccattatcgtgtcgctggtcggtacgtttgcctgcctggtggctgcggggttcagtctcaatatcctgacgctgtttgcactggtgcttgccatcggtacggtggtggacgatgccatcgtggtggtggaggcggtgcagtccaagttcgacgccggatataagtctccctaccttgccacgaaggatgcgatgggcgatgtgacgatggctatcatctcttgtacctgcgtgttcatggcggtgtttatccccgtgacgtttatgggtggtacttcgggtgtgttctatacgcagttcggcattacgatggcaacggcagtgggcatctccatgatttcggcattgacgctttgccccgccttgtgcgccatcatgatgcgtccgtcggacggcacgaagagtgcgaagagcatcaacggacgggtgcgcgtggcatacaatgcttcgttcaacgccgtgctgggaaaatataagaaaggtgtgatgttctttatccaccgccgctggatggtgtggacttcattggcggctaccgtcgtattgctggtttacttgatgagcaccaccaagacagggcttgtgccgcaggaggaccagggtgtcatcatggtgaacgtcagcacctcaccgggaagcacgctggaagaaactacgaaggtgatgaacaagttggaggatattctgaagagcacaccagagatagagcactatgccaaggtggcaggctacgggctgatgtccggtcagggaacttcctacggcaccatcatcatccgtctgaaggactggggtgagcgaaaggggagcgaacacacgtccgatgctgtggtggcacgcctcaatgcccagttctacggtgtgaaggaggcgcagatattcagcttccagccgggtatgattccgggctacggtatgggtaactccttagagctgaacctccaggacagaacgggcggtgacatggcaacgttctacgaggcagtgatacagttcctgggtgcgctgaaccagcgtcctgaggtggctatggcgtatacctcttatgctatgaacttcccgcaggtatcggtagatgtagatgcggccaagtgtaagcgtgcgggcatttcgccgagtgtggtgctcgacgcgttgggcagttattgcggtggagcttatatctccaattacaaccagttcggtaaggtataccgcgtcatgatgcaggcatcgcccgaatatcgtctggacgaacaggcactgggtaatatgtttgtgcgcaacggtacggagatggctccggtcagccagtttgtgacattgaatcgggtgcttggtccggagacggccaaccgcttcaatctgtatagcgccatctctgccaacgtgaatccggcagaaggatattcgtccggtgaagtgcagaaagtgattgcggaagtggcggaacagacattgccgctgggctacggttacgagtacggaggtatggcacgtgaggaagccaataccggtggtgcgcagactgtctttatttatgccatctgtatcttccttatctatctcattctggcatgtctctacgagagcttcctggtgccgtttgcggtcatcttctccgtaccgttcgggctgatgggttcgttcctctttgccaaagtccttggcttggagaacaacatctatttgcagacgggtgtaattatgttgattggtctgcttgccaagacagctattctgattacggagtatgccattgagcggcgccgcaagggaatgggcattgtggaatcggcctactcggccgcccaggtccgcctgcgtcctatcctgatgacggtgctgacgatgatattcggtatgcttccgttgatgttctcgagaggtgcgggtgccaacggcaactcttcgctgggtacgggtgtagtaggcggtatgcttgtaggaacattggcattgctatttgtggttcccgtattctatatcatctttgagtacttgcaggagaaggttcgtccgccaatggaggaagaagccgatatgcaggtattgcttgaaaagcagaagagtgaggcagaacgggcgaaagattgaggaaaataaaataaaaacagattggaacaatgaagaaacatatcatcctattgtccgccgccggtttgctgttcagcagttgcggcgtgtacaccaaatacaaacccgctaccgaggtccccgacggcctctacggggaagaaatagccacttttacggagagcaccgacggttctccggtggctcccgaagacagcctggaccttggcctgggcggcatggactggcacgagcttttcaccgacccgcatctgcaggcactcatcgggcaagggctacagaacaataccgactaccagttggcacaactccgtgtggaggaagccgaagccaccttgctgtccgcaaagcttgcttttctgccctcctttgcccttgcaccgcagggcacggtgagcagctttgacactcacaaggctacgcagacctattcgttgcccgtcactgccagttgggaactggatattttcggtcgtatgcgtaatgccaagaaacagtcgaaggcactctatgcgcagagccgggactaccgtcaggccgtgcgcacccaactcattgccgggatagccaatacttactataccttactgatgttggacgagcagcttgccatctccaggcagaccgaagagacgtggcgggaaaccgttgcttccacccgtgccctgatgaatgcgggcatggctaatgagtctgccgtgtcgcagatggaggccacatactatcaggtgcagacttccgtgcttgatttggaagaacagataaaccaggtggagaacagccttgcgctgttgctggcagagacgccccgtcattacgagcgcggtgtgctggcagagcagcagttccccgcggacttttccatagggattcctgtccggctgctttcctgccgtcctgatgtccgctcagccgagcggacactggaagcggcgttctacggtaccaatgcggcgcgttccgccttctatccctccattacgctgggtgggagtgcgggctggaccaattccgccggttcaatgattgtgaatcccggcaagttcctggcttcggcagtgggttcgctgacgcagccgctctttgcccgcgggcaggtcattgcacagtaccgcatagcccgtgcccagcaggaggaggcttcccttgccttccagcagacattgctgaatgcaggcagcgaggtgaacgatgccttgactgcttggcagacaagcctatccaaaagcgaactgctggacaagcaggtagcttccttgcagacagctgcccgcagcacttccctgctgatggagcatggcaacaccacctatctggaggtgcttaccgcccggcagacattgctcaacgcacaactggcacagacggcaaatcgattttctgaaatacaaagcctgattaacctctacaaggcgttaggaggaggtcaggaatagagtgtcatcatactactctctctgcatcttcattttaaatgtgaaggaagggctgtccgggaagtgattccaggacagcccgttttcaatgaataggagggatcaaatggaggcaagtatttctctggacaaattattgcagtttttcactcaatgcgaacgataagtgttggctcggtgagagatcgattgaagaaactgaaaaggaaactgaagcaaaagatagtgagtttaccggtaagaaggaggttttgccaggaattgatgcagggatgtagtaggtactgaaatagcttgttgttggatctatagatgcagcgtgttccatctatatatgcaacgcgttgcatatatagatccagcaaaccggaaatatacatgcaacgcggcatatctttcgggcggtttctctccgcctttgagggagcggtttatttatactgtgcccagtctacattcttcatgtctccacttttggccagctcagcgtgcatagccagtgcggcgcgcagagcgtggggagtttgtgatttgccgtcggtcagcttcaggtaatcccacagtatgttcttgtagtccggatggacacagttttcgatgatggcttgtgcacgctctttcggactcttgccgcggaggtcggccacaccttgttcggtgatgatgatattgacatcgtgttccgtgtggtctatgtgcgaaaccatcggcacgatagccgagattttaccttccttggcaacggacggacaagtgaagatggagatataggcattgcgggtgaagtcaccgcttccgccgatgccgttcatcatcttggttccgccgatgtgcgtggagttcacgttgccgtagatgtcggcttcgatggcagtgttgatggagatgataccgagtcggcgcaccacttccgggctgttagagatttccgacggacggagcaccagtttgtcgcggaagaagtccatatcctggtagataccttccagacagtcgttcgttacggtcagtgagcaggcgctgccgaatttcacgcggccttcgcggataagtccgataacggagttctggataacttctgtgtacatttcaaaagcagggatggtcttgtcacgtcccaaagcgcccagtacggcattggcaatgttgcccacaccggattgcaacggcaggaaggtaggcggaatgattccgcgtttcatgtcggcggcaaggaagtcggccacgttctgcccgattttgtcggtcagcgggtcggcggcggcaaacgaacgtgcctcgtccggccagttggtctccactacgccgacaatctttttcgggtctacctggatgtagggcaggccgatacggtcgctcggcttgtaaatggggatttcgcggcggtaaggagggtctaggggttcgtagacgtcgtgcagacccatggcactcttgctgtgggcggcattcagttccacgataatctggtcggctaggcggcagacagtcggagcgataccgccggctgccgtcaggtagattttaccgtcgggagtaacctcgcatgcctcgatgatggcaacattcacttttcccatgaaaccgtaacggacttcctgagccatctgtgaaaggtggatgtcgttgtaggctatttcaccgttgttcacggctttgcggaaatcagcgttggtggtgtaaggagcacggtagcggatagctttagcgcgtgaaaggataccgtcgcaggaatctccggtagaagcaccggtgaagatacctatctggaacgggtttccttttgcatgttctgcttccgcgatttttgctaattcagccgtaacggctttggctgttcctgcgggggtaaatccgctcaagccgatgttgtagccatgtttgatgaggctcgcagcttctgctgccgaaatgtaattgagtgccataatataaatagttattttttcgtgtaaagattctgaaggggctcgtaattggttctgcaattatcgactgtaaactatccgttctttaatattttcgttgaagtatttctgaccagataatggctttcctcgcttcttctgccgagtggatgccgtattcggacattgcttcatcagattcctgcggacgggatgccggggagggaggggaagcctttatggaagtgtgcttggatttggcagacggtttggataccggcttgggcttttctgtcggtttggggccttcgggaataaagcctccgtaagtgtcttcgccccagtattcgggcagtgggttgtcgacgtcgggcataggtatgtcgggactcttgtcagcgtttttatctgcttctttcttaaactgcttgacgagtccgattactatgacagccgcaactaacagaaacttgaagacatcttccatattctttttgattttccacccaaagatagtgcaattatctcttatctttgcttttgggcaaagttattatttaatctgattacagccaaggaattggtaataaaaaagggcagcttcacagctccccttaatttttttaacctaaaccttaactatgaaaaaatctaatgtttctttcattccacaaatttgtgaattaatttgctctatgccaaattaacactcggaaaatgtttattctcttaacattaattagctgataaggcgcagattgacaacttgtaatggcatttttctttcatttcatccgtttattgggagggaagaagtatctttgcgctccgaatgacagataccaacttatgatataaactgattttaaacgaattgattatggaaaaagtaacgggagcagactttaaatctgcaactgctgatgacaacaagaagttgtttatcgagacttacggctgccagatgaatgtggccgacagtgaagtgattgcatccgtcatgcagatggcgggatattcggtggccgacaccctggaggaagccgatgcggtgtttatgaatacctgctctatccgcgacaatgcggagcagaagattctgaaccgtctggaattcttccattcgcttaagaagaagaaacgcggcttgatagtgggtgtgctgggctgtatggcagagcgtgtgaaggacgacttaatcaccaaccatcatgtggacttggtggtgggaccggatgcctatcttactctgcccgaactgattgcctcggtagaggccggtgagaaagccatcaacgtggagctttccactacagagacctatcgggatgtcattccctcgcgcatctgcggaaaccacatctccggcttcgtgtccattatgcgtggttgcaacaatttctgtacctactgcatcgttccctacacccgtggccgcgagcgcagccgtgatgtggaaagcatcctcaatgaagtggccgacctcgtggcaaagggttacaaggaagttaccctgctgggacagaacgtcaattcctaccgcttcgagaagccggacggagagacggttaccttcccaatgctgctgcgcaccgtggcagaggcagcgccgggcgtacgtatccgtttcaccacctcgcaccctaaagacatgagcgacgaaactctccaggtcatcgccgacatgcccaacgtatgcaagcacatccacctgccggtgcagagtgggagcagccgcatcctgaagctgatgaaccgcaagtacgaccgcgagtggtatatggaccgcgtggcagccatccgccgcatcatccccgattgtggcttgtctacggatatattctccggtttccatagtgagacggaggaggaccaccagctttccctctcgctgatggaggagtgcggatacgattccgccttcatgttcaagtacagcgaacgccccggtacgcatgcttccaagcacctgccggacgatgtgcccgaggaggtgaagattcgccgtttgaatgaaatcatcgccttgcaaaaccgtctctctgccgaggcgaatgcccgttgcgtgggcaagacgtacgaggtgctggtggaaggtgtttccaaacgcagccgcgaccagttgttcggccgtacagaacagaaccgtgtggtggtgtttgaccgtggcacgcaccgtgtgggcgattttgtgatggtgaaggttaccgaatccagttcggctacgctgaaaggagaagaggtagccggctgacgggatagaaaagtctcgatgacatcagtatgatgacaccggtatatagaataaaagcacgagcctcacggcccgtgcttttcatattataaactttaaattttattctgccatggccagaatattcgctacgtagtcggtcttgttgtagcttaccagggtcaattcggactttggaacgtcctggttgtagagtttgtaagctaccggcatgttttcatcgttcaattcatacacacttttcttcatgtctttgtcataagccttgtgagactcgttccaacgtgcgtaggacatggtgatttcatcattgccatattggtatgtcattttaaagtaaggtatccattcatcttttgcaccgtcccacttggaggcttccttgcaggtcaggcgtttctggtcgtcataagagtattcataacggatgtgccggtaaagttgtgcgccgtcttgcttaaagatggtcttggcaactactaattcgtttttcacttcttcattggtgatgaagttgttttcctgagctttcacttctgtattcataacgcttacgatagtcattgctacgaatgcgactgccttgaataaatttgtagttttcataatctttatttttaattgttgttacttactctgtttcttttagacgttgttcccgattaaaaggttgcattccaactaatctttttctcaaacgccttcgcctaattatagtcaattcccatgccaaatatttaagttgttgataatcaatgaataaatgctttcgaaaactgttcattatcggacagttgtccgcttaatatcgaacagtcggtcattcgttccgccggctggccggagtaagcgtttgttttcttaaatctccttaatggaagccctataaatcactttttatttgttattttgcaccaaatttaggtatagtgtggtctgtttcatttgggctgcacttccttattggcagaacgttcgatgaataaactcactataaaagcttgtccgttatgtggtggaacgcatttggagcgtgccctgacatgtgtagaccattatgcctcgggcgaaatgttccacttgtgtcgctgccgggattgcggtttccttttcacgcaagactttcccgtggaggctgaaatcggtcgttactacgaaactcctgattacatttcacataccgatacccgcaagggggcgatgaactccgtgtaccactgggtgcgcaactatatgctgggacgcaaggcacgtcttgtggtccgtgaagcacaccgcaaggagggccgtctgctggatttgggtacggggaccggttactttgccgatgccatgcagcgtcgcggctggcaggtggaagctgtggaaaagagtgcgcaggcgcgtgcctttgccaaagaacacttcaatctggatgtgaaaccccatacggcattgaaagattttgcaccgggcagtttcgacgtcatcaccctatggcatgtcatggaacatctggaaccccttaacgaaacgtgggaaaccctgcactccctgctgactgaaaagggggtgctgattgtagctgtgcccaactgctcttccttcgatgcaaagaaatacggggcttactgggctgcctacgatgtgccccgccatttgtggcacttcacaccgggcaccatccagcaattcggttccaagcatggcttcatcatggcagagcggcatcccatgccgttcgatgctttctacgtgtccatgctgacggaaaagcacatgaggcactcgtgtactttcctgcggggaatggtgaccggtacactggcctggttcagcgcgttggtgaagaaggaacgcagcagttccatgatttacgtgttcaggaagaaagggtgagaaaagggattagggattaatgattaatagcgactgatttacataacttgtagcttgtaactcgtaacttataattgatataatgaaaggaaagaataactcggtatcctattttgacatgcagttcattacgtccagcatcagtacgacgctggtgttgctgctgttggggctggtcgtattctttgtgctcgcggctcataatctttccgtgtacgtcaaggagaacatcagtttctccgtgcttgtcagtgacgacatgaaggagagcgacatcctgaagctgcagaagaggctggacaaggaggcttttgtgaagcagacggagtacatttccaagaagcaggcactccgcgagcagactgaggcgatgggtacggacccgcaagagttccttggctacaatcctttcactgcctccatcgaaatcaagctgcattccgactatgccaattcggacagcatcgccaaaatagagaaactgattaaaaagaataccaacatccaggaagtgctctaccagaaagacttgatagatgccgtgaacgataatataaggaacatcagcctgatgcttctggggctggctgtgatactgacgtttatctcctttgcgctgataaacaacaccatccgtctggctatatattccaagcgtttccttatccacaccatgaagctggtgggggcaagctgggcattcatccgtcgtccgtttctgcggcgcaatttctggataggtgtgctggccgctttcatagccgacagtattctgtggggaaccgcctattggctggtgtcctacgaaccggagctggtcaaggtgattacgcccgaggtgatggtgctggtgtcgggtgccgtgctggtgttcggcatacttattacgtggctgtgcgctttactctccatcaacaaatatctgaggatgaaggcaagcacgctgtattatatttgacgccttaaagtgcatagagagaaagtactgttagtacggtacgttagattgtaaattgtaaatagttaaattgtaaatgtatagatgagtaaagagaaatttgcttttgataagaccaattttatcctgcttggcatcggaatggcggtggttatcattggttttcttctgatgaccggtcccgcgtctaccccgacgacctttgagccggacatttttagtgtgagacgcatcaaggtggctccggtggtttgcctgctggggtttgtgttcatgatatatgccgtgctgcgcaagcctaaaggcagcggcgcgggggagcagtaacccaaccccttacaccctaataacttataacttataattcataacagtggaatggtttgaagcgcttatccttgggcttattcaaggactgaccgaatatctgccggtgagcagtagcggacatcttgccatcggttcggcattgttcggcattgagggagaggagaatcttgcttttacgatagtggtacatgtggctacggtgttcagtacgctggtgatactctggaaagagattgactggattttcaagggactgttcaagtggcagatgaacgaggagacacgttacgtcatcaatatactggtatccatgatacctatcggcattgtgggggtatttttcaaggacgaagtagaggccattttcggttcgggactggtcgttgtgggctgctgcctgctgctgacagctctgctgctgtctttctcctattattataagccgaagcagaaggagaacatcagcatgaaggatgcctttatcatcggtctggcacaagcatgcgcggtgcttccggggctttcccgttcgggcagcaccattgcaaccggtctgttgctgggcgacaacaaggcgaagctggcacagttctctttcctgatggtgatgcctcccatcctgggcgaggcactgctggatggaatgaagatgatgaaaggtgaggcggttgcaggggatattccgacgctttcgctggtggtaggtttcctggctgcttttgtttcgggctgcctggcctgcaagtggatgataaatattgtgaagaagggcaagctgatttattttgccatctattgcgcgatagccggtgtcataacgctcatattaagctaaagcccctccttgtgtgggggaaagactgattactccggaaatcaataagagaaaaatattaagttgtaccattttatccccctccctaccgaggaggggttaggggagaggccaatgaattttaaagaaggagaagtcctctatttcaataaaccgctgggatggacatcgttcaaggttgtgggacatgcgcgttaccacatctgccggcggataaaggagaagaagttgaaagtaggccatgccggtaccctcgacccgcttgctacgggggttatgatagtctgtacgggcaaggccacgaaacggattgaggaattccagtatcacacgaaggagtacgttgccaccatccggttgggtgccaccactccctcttacgacctggaacatgagatagatgccacctatcccacggagcacatcacccgcggactggtggaggagacgctgaagaagttcatcggcgagatacagcaagtgcctcccgccttctcggcatgtatggtgaacgggaaacgtgcctacgaccttgcccgcaagggagaggaggtagagctgaaacccaagttgctcgtcatcgacgagatagagctgctggacgacgggctggatattgccgaaccgtggataaaggtacgcgtagtatgcagcaaaggaacctatatccgcgccctggcacgtgacatcggcgaagccctgcagagcggcgcccacctcaccgccttggagcgtacccgtgtaggcgacgtccggctggcagactgcctcaatcccctcgatttcaaagagtggatagaggcgcaggagatagatatttagttataagttatgagttataagttatttgctatgaagtgtagcatactgccggataactcataccctcttatgactaaaacagactgatataaataataaataactcataacttataactcataactaattatgaaactgtcgcaattcaaattcaagcttcccgaagagaagatagctttgcaccccacgaagtacagagacgagtcacgtctgctggtgttgcaccgtaagacgggtgagattgagcacaagatgttcaaggatgttctggactattttgatgacaaagatgtgtttatcttcaacgacaccaaggttttccctgcccgcttgtacggtaacaaggaaaagaccggtgcgcgtattgaagtgttcttgttgcgtgagttgaacgaagagctccggttgtgggatgtactggtggaccctgcccgtaaaatacgtatcggcaataagctctacttcggtgacgacgactccatggtggctgaggttatcgacaacaccacttcgcgcgggcgtacgcttcgtttcctttacgacggtccgcacgatgagttcaagaaggcgctctatgcgctgggcgaaacgccgctgccccacagcatcatcaaccgtcccgtagagccggacgatgccgaacgtttccagtctatttttgcacgcaacgaaggagctgttacggcgcctaccgccagcctgcacttcagccgcgagctgatgaagcgtatggaaatcaagggtattgactttgcctacatcaccctgcatgctggcttgggtaacttccgagacattgatgtggaagaccttaccaagcacaagacagactccgagcagatgattgtgaacgaggaagccgtacggattgtgaaccatgccaaagacctgaaccgccaagtctgtgccgtaggtaccaccgtgatgcgtgccatcgagagcaccgtcagcaccgacggacatttgaaggaatacgagggttggaccaacaagttcatcttcccgccgtacgactttaccgtggccaatgccatgatatccaacttccacatgccgctcagtaccctgctgatgattgttgccgctttcggcggttacgagcaggtgatggaggcatacaatgtggcattgaaggaagagtaccgctttggtacgtatggagatgcgatgctgattacagaccggtaattatggttgtttatttcagtcttggtaccaatctcggcgataaggagcagaacctccgcatggccgtccaaaagataagaaagcagataggtgaagtgatttccctatctgctttttatgctactgctccgtggggcttttcttccgataatacttttctgaatgccgcactctgcgtagacactgctttggcgcctttggaggtgttgcaaacgacgcaggaaatcgagcgggagatggggcgtacgcataagtctgtcaatgcagtgtatagcgaccgtgtgatagacatcgacctgttgctctgttttgccgatgacggtactcccgttttgctggatactcccgaactgaaacttcctcatccgctgatgcaggaacgccgtttcgtgatggagccgttggcggagattgcttcaggcgtggtgcacccggtattgggaaagacaatcggggaattgttgcaaaatcagtgttaatctctgctatctgtagcgcagatacaagatttcttttttatctttgcctccggaaagcgaagataggctgcacctcagcataaaaaatgaacaagttcattttgttctgcgttcggtttgcactatctttgcgcccgaaaacgatatgtggagagatttgagtagcttgcaaccacagaaaaaaatgctaaaacacatccttttctgacggcacgtttgtgtgccggatgcatctactccacacacctccttccgccattcgttgaattatcaattatcaactatcaattctcaactgaaatgggatatttattcacatccgaatcggtgtctgaaggacaccccgacaaagtggccgaccaaatatcggacgctgtgcttgacaaactgttggcctacgaccccagttcgaaagtagcttgcgaaactctggttactaccggtcaggtagtgctggctggagaagtgaaaaccaaagcgtacgttgacatgcctctcatcgcacgcgaagtaatcaagaaaatcggctataccaaaggcgagtatatgttcgagagcaattcgtgcggcgtgctgagcgccatccacgagcagagccccgacatcaaccgcggcgtggagcgacaggaccccatggaacaaggtgccggagaccagggaatgatgttcggctacgccaccaacgaaacggagaattacatgccgctttcactggaccttgcacaccgcatcctgcaagtgctggcagatgtccgtcgcgaaggcaaggtgatgacctacctccgtcccgacgccaagagccaggttaccatcgaatatgatgacaacggcacgccggtacgcatcgacaccatcgtagtctccacccagcacgacgacttcgtccagcctgccgacgacagtgatgccgcccagctgaaggccgacgaggaaatgctcgcccaaatccgccgggatgtaatcgagattctgatgccgcgtgtcattgcttccatccatcatgaaaaggtgctggcactgttcaacgaccatatcacataccacgtcaaccccacgggcaagttcgtaatcggtggtcctcacggtgacaccgggctgacgggacgcaagattatcgtagatacctacggtggcaagggtgcccacggcggcggcgctttctccggaaaggacccctctaaggtagaccgcagcgcagcttatgcagcccgccacattgccaagaatctggtagctgccggcgttgccgacgaaatgctggtgcaggtaagttacgccatcggtgtggcacgccccatcaatattttcgtagatacttatggccgcagccacgtcaatatgagcgacggtgagattgcccgtaagattgacgagctgttcgaccttcgccccaaggcaatagaagaccgcctgaaactgcgcaaccccatctatcaggagactgccgcctacggacacatgggccgcgagccgcagaccatcgtcaagcatttcaagagccgctacgaaggcaacaaggacattgaagtggaactcttcacctgggagaagctggactatgtggacaaggtgaaagccgcattcggtttataatcagcatagctttacggctatttatatagaaggctgcccttctgcatctccggaatatcggtatatgcagaagaggtggctttcgtgtttttgctcgtcacgggggcatggtggtttatcaacaagcgattcttcttctctcttttccttattttacaagcaattttgccattgcattcgtagcttacctgcaaaatgtgcatggaatgtgtacagtaatctcctctaaatagtgtacctttgtgaacaacaacgaatatagggctgcctatgagataccttttgcttgctttttccttctttttagtaacttctgtgctgtgccagtcgtgcaaggaggaagtcacttctgcacgttccatgctcgtggcagcagattccatgatgtggagcaatcccgacagtgctttgctggtgttggaacagataccggattcccgcgagttgcggggagaagaacgcgccttgtatgcgttgctgctgacgcaagcccgatacaagagttgtgtgctgctggagaacgattcgctgatacagatagcggtagactattacgaaggaggcggaaagcaggaacggctggcgcaagcatatttctattggggatgtgtctatatggaaaataaagagtttccgaaggcgataagcctctatctgaagtcgctggaactgatgccaaagaaagactctatattcgtggcgatgctgtacagccatttggggaactgttataatgagcaagatttacattctacggcaagggaaatgtatcggaagggatataatttatgtgcagtgaaggattctgcacgttctttttatgcattaagagatattggaaatacctttttgttggaatatcaattggatagtgcgctttgttactatcaacaagctttaaaaattgcatcctcgctgcaagacaatgagtgtttatcccttatttataaaaacatagcggggctttataatgagttggggcggtatatggaggcggaatcggctctttcaaaagctttaccctatttgaccgttgaggaagattatacatcggcttgttctataaagggggatattctaaattccttaaatcggaatgattctgctgtttattattggaaaattggagcaaggtcttctaatatatatgtaaagacatcgtcttataatcatttgtttgaaggatataaaaaaatgaaggattgggaaaatgctactgtatatgttgactctttcattcttttctatgactccattcaaatgatgaattatcgtgcagaacttgatgaactgatggataatcatttaatagaacttcataaacgtgaattgtctgtcagaaatcaacggatagttgcaggcttggcggttctttttttgttattcatgtttgtattggtcattgtttatctgtggcgtgatgcccgtaggaaaaaggagtatatggctttgcagcagcgcttgatggaaaaccgtgcggaggtgatgcttttgaatgaaattcctgaatcagcttctaatacgaaagtagcagaattacacaaattggaggaggaacgattcagtatctgtgtttctatatttagaaccaccgagggaagtagaaaacttgatgaattgaagaaagcaactgctaaaatgcaggtttcgattgcagatacttataggcaagtgatggtgagtgatataagaaagacttttgccgatgtcatgaaagatttgaaggaacactatcccggtttgactaatgatgatttgctttattgtatattgtctttgctccgttgttccaaatttattgttttatgtatactggatgtctcttcggacgctataaaaacgagaaagagccgtatcaagaataaaattgatgaagaactgttcaatcgtatgtttgactattgataaatagcgtattatgatggatttgttacttctgttacattgctctgttaccactgttacctcttttttgtaggctttcttataaaagattaagttatttgcagtattaaacttttaataacttaattaataatgagaacaagaaaactactattgtgtctatttgcatttacttgtatgaatataaatgcaatgtctcagaaacgaccgaaaaagatagatcttgaaaaaattgtagcttcttctactacaaatagtaaaggaacacgttctgctatcttagaggcttctgcattattcgattctaattcagaatcaattatgataacttcttagaatggctttgctgatgtcaaggtttcagttaccaacctttttactaatgaaaccatcttttctgattcatactctacttttgagataatactaaatttagcaggcttattaaatgaaggagaagagtatcgtttagaaattactatcggagataccgttttatacggggattttatttactaacattatatttaagaaaaaatgaagaaacatttgctgttcgcctttttaggtgcgctggcttgttactcatgcagtaacagctacgatttgttggaaaatgatgcggagcttgctaaagctgctgaagattatgagctatcaaccagagcaattaatgaggagggggatacggcaaaaattgagactgtagccgatgaacaagttattcaggctttgatggatgagtacgagcaggaattaatgaatagacagtctgttgctaaagaaagagtaatgagaactgcttacactggaactactgatgtagtaggggtgttcaaagtagagtcatgtgggacttataaagaactgacactttatcttgatgcagaagatacaagacagaattctaagattgaaggttatgtaggagatacgtttgtagataataatggcaatgtccgtttcaaattctgcttgacggaagcaactcaatattatcctggaggagtttttcttgttgaccatataaattacagtcagtttggtggtacaatggatatacttgttcgttatcatgattgtgatgataagcatactgataataaaataattgatagcacacatcctgaataccaaagaattgatcagcttggagggtatactgtcgtgaattctaatgcagcattagcctgggcttaccctccttatcctcgcaatcaatggggctatattcctggagttggtcctcgaaattctattaagtatggagttttagcttatgcctatactattgaggacttaggcatgatttatgttgatgacgaagattccagcaataaaaactggcttaaatcctataagggatatacatacaaagataaattgtctggtgaccaaggcatgtatggaattaatgctacagacaacacaagatattatgttttattaaacacaaacaaaggttttgcattgaataatatattccatcctaattttggaacccctataccaagaccgtaataatatgaaatatcaaatattttgctgtttacttcttttatgctcttgttccaactgggacaagagcattgtggcagaagtgaatggacataaagtttattcttccgagctgtctcaattaactacccaagagacttttgatttgcttaatacagcttatgagataaagatgaaggctttggaagacttgattaaacaaaagttgatagagcaagaagccaccgttgcaggaaaaactttcgagacttttttgaatgactatatagaaaaggtgatgagcattaaagaagacagcctgcttgcagtgtatggttctgtaaatgagcgaattctccattcaagggagagattaaacaagatttcttcagaaagtattgaaggaactatttctgtgaagaatgatattcgtgcagctatcattcagcatttggcagattcattgtataataaggcgcaagttaaaagatacctttatcctcctaaacagcccaaatgtgttgttggtgatttgaacgtgcgctataggggcaatctgaatgctgctacaactttcattgttgcttccgactttgactgcaaacgttgtgttgattttgaaaagacattgaggcggatttatgataaatacaaggagcgggtaaagtttggattcatcaattttgctgatgagcctacccttgcatccttatcgtgcgaggctgcttccaggtatggtaaattctgggagttccacgatgctatttttgaacacgaagctttggtagattcatcttttatttttaatatagccacaaatttgggtttagacttagaagcatataaacaagagttgttgtctgctccaaattatgataaggtaaaccatgctatcaataagttgatggaacgggggctttttgccactcctaccattatcattaataacagactagtatacatcacaaattcgtatgaggaactgactagactcttagaccaagaattacaaaacagataaactctgatgccgatggtaagataccttacaattacatttctggccggcctttctctcctgcttgcaagttgtgaggaagtgtttgatgtcaatatccccgattctatgcttgagggaattgtatttaatggagtaattacaaacgaaaatcccccttatttctttcttttgagggaaccggcattgatgtcggctgaagattatgcctatgagggtatagaagatgctgtgatgattgttacggaccttactgaaggtatcagagatactatgcaggtgctttatccgtatggtgattacggtggagtgttttatgatttttatgattatcatttaaagaagaatactcgcgaaagagtgaacctcatgtatgataatggttctggcaggggtatgtatgtcactaccaaaatttatggcatagaaggtcattcttatcaattggatatttatcacgatggtaagcattatcagtccgatgtccagaagatggagcctgcacttgtcattactgatttgaagctgaaatatttcgactttaatgaaaaaggaggcaggtgggcgccatgtataagtttcactaatccgtctgaggtagataactattatttgttccggttatattcgcgtacttacaagcatttttctttttcgcgccctcactctttgttgggctccaataccttttgggagtattctatcttgagcgatgagtatcttgaagagaatgtggttgattttctgattgacgacggagaaaatcctctgggttatcctccgggttgggattatcccatgggagattctgtatatgtatgggctcagaccatatccaagagttgttatgacgttttcgaccagatgatacgccagttccggtcggatggtggcgcttatacacctgcaccgtcatcggtgggcagcaatataagcggcggggcgtatggctgcttccgtgtgagtgcggtttccgaaaaaggtattgcaacgggggaaagatgatgcgttcttttttgtaatcgtaagaagataaaattaatgaaactgttgctgatttatttctgtattttgtttttgagttgtcaggcagtggttgctcaaaaggccgttgtacgaggatgtgtgacggatgccaaaacgggtgagattctttcggatgccaatgtgctggaacgaaggtcgggaacggggatggcaaccaatgcttacggactttattccatatcacttcccaaaagggaatgtatattgcaatgttccatgttggggtatgttacttggagagataccttgactttatcaggaaatacggtggtgaatatcgcattgactcccgatgattattggctgaaaggtatcgagatagtgggaagccgcaagcatagcggacaatttgctttggaagcaaaggaaatacaagcattgccatctgtgggaggggaaccggatttgatgaagtcattgcagtttctgcccggagtgcagagtggcaatgaagggacaaacaatatttctgtacggggtagtaaccaatggggaaatctggtcttgctggatgaggctgtagtttataaccccagtcatgtattgtccttcttttcggtgttcaacaacgatgccatccgtgaggtgaacttgtacaaatcgttcttcccgctgaagtatggcggtcgttcttcatccgtcatagacgtgcgtatgcgcgaaggtaacagcaaggaacgtgaacggagtgccagcttggggctgatagcctcgaaagtgttgttggagggacctttgaagaagaaagaggggtcttatctggtttccggccggtttggatatccgggtgtagtagccggactgttgggaagtaacctgacgtcgaaaccgcagatgtggttttatgatgtcaatgccaaagtgaacagaacgctggatgctcgaaatcgtatgttcttttccttgtatagcggaggcgaccataccgtgttcaacaagctggtgaaaggctatgggatggattggggaaatgctacggctacgatacgttggaatcatatactgaatgataagacaaatgtgaatacaagcgctgtcttcagcaactattattataagtacaaatcgttgtcggacggattgagatatgtgtggaagtcgaacatgcagtcgtatcagttgaagtcggattgggagaggtatcagaacaatctgctgaccttgaagggaggggtgaacctgcattatttcactacgatgcccggtgaggtgggcaagtccggtaaggattctaacatcactccttcggaaatgtcgcgcaagagtttgtgggatgcggcattgtatgccgaggcaaattataaattcctgccccgttttcttctgaatgccggggttaggctgtccgtattgcatgcaccggcctctacctattatgcagccaagacatttgtgatgcccgaaccccgtgccgaactctcttttattccgaatgcctcgcaccggttttccgcatcgtatacacaggcggcacagagcatacacatgcttaccacctcttcagtaggtatcccctcggacatgtggatgcctgccaatgcactgttgaagccctccgtcatgcgccaactggcattgggatatgaatacaatttccctgataaggaatatacattgtcactggaggcatatatgcgccgaacaaaccatgtggtagattataggaaaaatgccgatatttttcagaacgaccggatagaggatgaagtcgaaaccggttctgccagagggtgtggattggaattctatttgtcaaagaataaaggagccgtgaccggatggattagttatactctctcgcgtgcgcgtaaccgtataggaggagaggagtaccgaccggtgtacgaccgtccccataacctgaaattgttcgtaaactgggaaatgaacagacattggtctctgtcttccactttctcctatgcatcggggatgaatcttacgcttcccgttggaaagtatgaatcggaacatgtactggtctatatttattctgaccggaatggttatcgtgccccggctttccaccagttggacttttcggcaacgtggcgtatcaggcaagaccgtagcttgagcctttccatcatcaatgcttatagccggaaaaatgtgttctctatttatgcagggaggcaggggcacttttctgtaggaaacgggcgtatctataaactgtatctttatggcatcgtcccttcgctgacctattctttcaagttttgagataactcttatttttttcctccaccggcagtacaaacacgaaccttgccccctccttgtactccttgtccagcagcactttccctttcagtcgttcggcgatgaggcggcagatattgagtcccaggccggtgccttgctcgaagttgtcggccttttcaaagcgttcgaagatggtttccgagtattccgggggaatgccggtaccggtatcggtgacggagaaggtgacgtatccgggatgctctgtgagggagcagtgcaggcggatttcgccttgtgtggtgtgtttctcggcattggtaaggaagttgatgagtatctggcacacacgttgcccgtcggtgctcagttcgtagcagtcgtccacttcggaggtgtagtagagcttcacgccttcgggcgtgcggtgttcaacggtggttatggcttcccggcagagtttgttgcaactgtgcggcgctatcttcatggtgtatctgttgctttccaactcggctgcgctgaggatgtcctccaccagtgtgaggaggaggtcggaattgtgctgtatgagatggcagaaatcctgcctttcctcttgggaaaggttcgtgtcgggggaagtgatgagttgtgagaagcccacgatagagttgagcggtgtccgtatttcgtgactcatgttctgcaggaagatgctctttgccttgttggctgcttcggcttggtcgcgcgcttcggaaagttcctcgttcttgtggcatagttcgaggttgactttacgtttgcggtggaggtagagcattaggaaaagcagagataacagtaaaaagccggtgacaatgctgaaaagagtgatgcggtagcgcgaggtggcctgtatgttttctattttcaggcgttcggcgcctatctgggtgttcagttcggcgatgtccgacagttgcagcagattgtttgtcgaatccaactgctggtaatattttttcagatatttgatggcattgggatagtctttggcgcattcgtaaatgtaggcatgttgttgcaagcctttctcggacaattggtcagcgtgggcatgggcctgctcatactgtttgtccagtatgttcttgctgatgtgggctatcagtagggaaacgttggcagagagcttgcagcggtctgccatttgtacggcttctttataacagtcgttgaattcatctatacgtttctgcttgaacagtatcaagcatttctctatcatggcttgggctatgttccgttctgttttagcgctcttcaaggctttttcgcaatagtccagtgcggtggcgtaatctttttgggtgttacggtaatattcggcaaggtttgagtatagttggctgggatcctggtcgggcatattcttcagcatatagtccaaggcttcctgatagtattgggcggagaggtcgaagtttccgcgtgatttgtagatatggcccatggttcggatacagctgaagataccgtaagggtatctgtcggcaaaagcttgctttttcattttttccgctttctgcaaggcgagcaatgagcgttgttggttcaggaagtagatgatttcgctgctccaagcgtgataataatattgcagatagttattggcacgtgaaatctctttcaggtcagtggatgccttttctattttgctatcatctttttgggatatatagaactgcagggggatgatgtatgccaggcattgtgcttttttgtcaccgagcttcagagcctgttgatacaaagtgtcggccaccagcagcccctcctgctggcgtgcctgcttggaagcccgctggtagatggggtagagtgcatcgtctatcttgtagggattgttctgtgctgcggaaggtagggacacccatactgaaagcactagaaaacataaccttgaaagaatgcactccctctttgttctattggatggaataagcatgttttttccggatacttattattatgcctatggcatcgcaaaaataagataaaagaataaattacaagttttttatttgcataatttctctatttacttgttaaatagttcttgtcaggagtgttcttacgaaatttccggtgataatgccgccctctacatcatcatattcttccttattgagaacttcacgatggccatcgcttcgaccttcaggacacggcaggttcgggcggcaacgacggcgaccagggcgaaaatcctttgggataaaattatttacgatttgacgatgtacgattggagttagtactgctaaatagccgcgcctgtgtaggcatttatgatacgaggagtaatcccaatcgtacatcgtcaaatcgtacatctcttaatcattaactcttaatccctattcatcattcatgcgaaaaatcaacaacatcgtggtgcattgcagcgccacgcgggagggccatgcgctcactcccgaagctttggaggcagagcaccgccgtcgcggcttccgcacgacgggctatcactactatatccggcgcgacggcactgtgctcggggcccgctctctggaactgcggccacaacaagtattcggtcggcatctgctacgaaggcggactggatgccatggggaatccgaaagatacccgcaccccggagcagcgttcggcactccggctgctggtacaccagctgctgaagcagttccggaatgcccgtgtctgcggccaccgcgacctgagtccggatttggacggggacggaacggtgcagccacgggagtgggtgaagcagtgcccgtgcttcgaggttagtaaagaactttaatccccccctaggactccctgaagggggagggggatagtcctgaagattgagcgcgcgcaggattggcgggagtattctccttcccctttaggggaacgaggggtctaaaaacacagaacatcatgaaaataagtaaagaaacttggaaagacatcctgaaaattgtgggtactatcatcgctaccatagccagtgtgctgggggtgcaggcgatgccgctctgatttcccggatgacaactaccccgcttacagcttggtatacaaagctaccaagtggggcagttttatgaaaaaaaacagaaagcattcgttcaagtttcgcaagtcctctgttgaaagtcaattattggatttacgaaacttaagacttttactcatcaggaaatacaaaaaaacatgaagcgaacaatttatatcctattttgctgcctatggtgtgcaattgctacgtttgcgcagtcagacaatattcttatctctaatgtgactccaccttcccctcatgcacaaagcatgctgaaggcaggacattttccggtgtccggctatacaggggtaccggatattaccatccccctctataccgtccagttgaaagatttttcctttcccgtctctctttcctacaatgcctcgggcatcaaggtaaatgaggaggccactcgggtagggctgggctggacattgaatgccggcggagttgtgacccataccgtgagaggacgttatcaggacttctgcgagtgggcctatttcaatgactccccggataaccagctccaggacattgcgggcatctatcatatcgacacttatcttacgcagggagccggcacttccttgccgttcgctctaccccaaggtatgacccatgaaatgctgtacagagctttgacgagcgatacttatgccagttgtggcggtacggaactggctcctgatgtcttccactatcacttcttgggatattcgggaaagttcatattttctcactcgggccacatagtgaaggaaagagaagacaatgtgcggattacgcctcttacggaaaacgatgctatgggccatcccaaactggccggctgggtcatgaccacccccgatggcactgaataccgttttgaacagactgaacagacgtttttcacagacagtccgcgtgcagaaagctattccagtgctttctacctgacgcggataaagacaacggccgaagcagtggttacattcggctataaaaccagggatttccatttggcttcttttgccaatattcaggacagtcggatggaacaatatatcaccgcggatatggcttattacaaggtgccctatctggatagaatcagttatcccggtggcagcattagttttgagtatgccacagaccggttggactacagttcggaagtgcgcttgtcggctgttcgcatcaacgacgctgcgggcaacaatctgagcaagtgggagttgattcagggatattttgtttccaatgccaacactggcttcgatgtgcctacccttgacgaactgaatcgcaggctgcctaacagcgcttattacaactccacatggaacaacaagatgtttacgaaagattggaataccaaaagactgaaactgaccggactcaaacatacggcaagcaatgtggcttcaccggaagtctattccttttcctacaacgaagccgctctacccaccaagttgtcggaagctcgtgatcattggggatattataatggtgcggccaacaaaagtctgattcctgcctattgctgtaacagcaatcaaaagtctgattcggtcattttggaacatggaggcagtgccgatcgcgaacccactccggcattcgcacaagcattccagttgaggtgggtgacatatccgacggggggaacggcggaattcacctatgaatcgaatgtatacaagacaaatgattttgaacaagacccctataaaaaagatttgatgtaccgcgtacaagaggtggtattgtctgccagccagcgccacaaatacgacagctacggcaatcctctgtatgtctctgccgatggaaccggaaacatggttttcctatggagctaccaaggcatgtacccggtggcaaaaatcgtgaatgccacgtatgaagaggtaaaggcagccctgggcaccgctcccgaatcactgtcctcctcttccagtcccgatacggcactgatagacggactgaggacgaaattgggcaaggcgcatgtcaccacctatacctataaaccccaggtggggttgctgacagaaacttctccggcaggaacaaccacttactacggatacgacaacttcggccgcctgtcagaagtctggatgctggaaggactgtccagaaaagtgcttcaatcctatgaatataattatgtcaatccctaaaacaacatggctatgaataagattttaagatatatactattgatattcgctttgggcatctctttggaaatgcagtctcaaagctccggtccggcaacggtctcgttcagcaaggacaagaattatgtggctacgctcactccccgcaacggggtttcctccgtggcttgcaacaacgggacaatcagcaattacgaaagcggcaacgtgcaggtttccatctgttacatggatggattgggacgcccggcgcagcaggtggaataccgcacttcgcctgcgggaaaggatctgataagcatgcaggagtacgcttcccttgatgtgccggaaaagcactggctgccggtggctttcagtgcgggcggggcatataccgccccctcctctgtcacggcacaggcacggacgaactacggcgacaccgctccttatggcatgtcttcctatgaggaacccatacaccgacgcgtctgtgaggagtatggtgccggccagctgtggcacgacaaccggaagcgtgtgcagacaagctacctgaccaacaggacgggcgacaaccggcttgactgcatccgctacaaggtagggggtgtcgggagcggcactgcattggtgcaatccggcagctatgcttcgggagagctcagtgtggtatgcaccacggacgaggacgggaacgtttcctacctgtttaccgacaagctgggacgtatggtattgcagcgctgggtcattggaagcgacaaccacgacacctactacgtctacgacaaccggggcaatctccgcttcgtccttcccccgcgcatccgggacgagggaatctcacaagacaagctggatgcactggcctattgctatcggtacgacagccgtgaccggtgcgtgtggaggaagctgcccggctgtgatgccgtgcgctatgtctacgacaaggccgaccgtctgattttcgtgcaggtattgtatattctttattatcaacagaatacagatagtgtagttccgcgaaaactttggtgatttcgtacattggcatgcagactcaagaggttgagattaagccgaatataaaagtattcatgcgttccgattctgagatgcttgatgaggtaatggtggtagcttacggaacagcaaagaagtccgcttttactggttcagcctctgtgatcaagtctgagacattggagaagcgtcaagtctccaacttatcgaacgcactttccggtactgtatctggtgtgcagacacaaagtacaaatggccagccgggtacgagtgcgacagttcgtattcgcggtattggttctatgtatgccagcaacaatcctttgtatgtagtggatggcattccttatgaaggagatatctccgctgtcaattcacaagatattgaatcgatgaccgtattgaaagatgctgcagctgctgctctgtatggcgcacgtggtgcaaacggtgttattttggttactacaaaaaaaggtaagagcggtgatacgcagatttctttagacgcccgttggggagtcaactcccgcttagtaaaaaactatgatgtattgcagaatgcaaatacctatatggagactgcatattctgctttgtacaacggatacctatataatagcggatatacagcagaacaggcttatcaattggccaatgcagacttgtttcccaagctgggctatcaagtttataccatacctgatggacaatatcttattggtcggaacggcaagttaaaccctcatgcagctttgggatatagtgacggtgactattattatacaccggacaactggtctgatgagatgttccaaagtaatttgcgccaagagtataatcttagtgtttctggtggttcggacaaattaagttactatctgtctgccagttatttgaatgatgaaggtattattgaaaattcaggtttcgaacgtatctccactcgtatgaacgtggattatcaggctaaaaagtggttgaaacttggagtgaatcttagctattcgaatgtaacaagccgttcaccgggcgatcaggataccgatgccgctacttcttccggcaatgcgttctttgttggtaactttattgcaccaatctatccgatgtatgtacggaatgcagacggcagcttccaatataatgccaataccggctatcatgtatacgactatggtgatggttcaagtacaaacttcacccgtaattttatgagtatgtccaatcctatgagcggtttcctttatgatactgaaaaatatctgatggatatcctgaatgggaaatggtatgcaaagattgatatcattgacggtttgtcattgacagcttctttgggcttgcatattgacaacacacgccagcatagtgtgggtaacaagtattatggtcagtcggcttcctatggcggttctgttatgcaatactcctcacgcgtttattcgcttgaccaacaatatctgttgaattacaaaaagacattcggcaaccataacttggatattcttgccggctatgaaagtatggacttcaacacggaaagtcactatattttaggatataacatgtatagtgacaagaactggactgcatctaatgttatcgaccgcaagaatggttctggcagttacaatgaatatgccacaatcggtatcattacacgtgccagctacgatttcaatgaaaaatattatggcagtgtttcttatcgtcgtgatgcttcttcacgcttccatccggataaccgttggggtaacttctggagtgtgagtgcagcatgggatatggcaaaagaagactttatcagtcaatacgattggatcaacatgctgaagctgaaggcttctttcggtcagcagggtaatgacaacctctattataaaggatatacaaactactatccgtatctggatcagttcacggttagcgggtctgacggtgtattctctgatggtgtgctctactacaagggaagcaaagatatcacttgggaaacatccaattcattcaatgtaggtgtggatttcgctcttttgggaggacgtattgacggtacaatcgaatacttcaaccgccagactaaggatatgttgtattataaaccggtagcgatgtctaacggttatacccaacttcctatgaatatcggttcggtacgcaactccggtgtggaaattgaattgaactatactcctattgaaactaatgatttaaagtgggtgatcaattggaatggaacattgatgaaaaataagattcttgagctgcatccggatttgaaaggagagatgattgatggttcctatatttatcgtgaaggtgaatctttgtaccagatgtatttgacaaaatatgcaggggtagatcctgattccggcgaagctctgtattgggcaaaggacgaaaacggtgtagagcataaggataaagattggtctgctgcctacaattccaatagacaagcttccggtgacctgttgcctactatctatggcggtgtcggtacaacattggagttccgtggctttgatttctccatccagtgtgcttatcagttgggtggtacgatttatgatagtggctatcaagctttcatgcatggcggtgactcccactacatgggatataactggcacaaggatatcttgaatgcatggacaccggagaatagaaataccaatattccgcgtgtagatgccattgataaatacaccaactcttcatcagaccgttggttgacaagttctgattatttctctatcaacaacatcaccctgggctatactttacctaagagatggttgagaagtctgggtatcggaagcttgcgtatttacggtgcggctgacaatgtggctcttttctctgcccgtaaagggcttgatccacgtatgagctacacaacagcttctacagatagatatacgcctatacgtactatttccggcggtttgaaagtaacattctgataatagttcaataataaaatacagaaaaaatatgaagaaattatataagataacaccgtatgttatgctcggtttgatggtagctggatgtacagatctggatacagaaccgctgagttcgactattacatctgaccaaaaggaagaagttgttgaatctgatccttccagattggaagccagcgtagcagccgtggctgcaaatttcacccaatatgccaaaatctacacagaagatgacaatgtgcatagtgatataggttatccgaccattatgctggccacggaatcaagaggtacggacatggtggcagatattactggttataactggtattccaattcagccgattacagtgactgcttgaatacaagtacagctaccattgaattctggggtacattgtacaatcagatttttacagccaataacgtaatcggtactgtagataacgaaactgaagatcctacgttacaatattatctggcgcaggcattagctgtccgtgcttttgactattttacgttgatacagttgtatcagttcaattacaaaggacatgagagtgccatgggtatgcctttgattacagagcagaatgcaacagaagttgcagccaatggttgcgcccgttctacggtgcaggaaacttatgattttatcttggcagacctgaataaagctattgagttgctgacagccactacaaaagaacgtgctgacaagcgctatgtcagcttggatgtcgcttacggtatccgtgcgcgtgtctacttggcaatgcacaactatgcagaagctttaaaggatgcggaagccgcactggccaaaactactgccactccatactcccgtgctgatgtaagcaagccttcattcattaatatcgaagacaattcatggatgtggggtatcttgattacagaacaggaccgtgtaagtacaaccggtatttgtaacttcccgtcacacatgggatctttgaattatggttatgcttctgtaggcggatggcgtagaatcagtccgaaactctataatgagattcctgccagtgatgtccgcaagggatggttcctgaacggtgaaggtatatccgccaatttgcctgctgcagcccaggcatatattactgggaaaaaggcacctgcctatacacaagtgaagtatggggtgctgaatgaccaatggggaactgacaacaatgctacggatataatattgatgcgtgttgaggaaatgtatcttatcaaggctgaggcacaagctatgagtggtaatgtcagtggcggtgtatctacccttaactcgtttgttactgcatatcgtgacccgtcttatcagtgtacagccactacaccggaagctgtgcaggaagctgtttggcaacaacgtcgtcttgaattctggggagaaggtatggcatattttgatattatgcgtctgaacaagggagtcaaccgtttaggctgcggcttcccgactactgccgtatttaatattacagcaggtgatccggttcaaatttacagtattcctaataaggaagtacaatataacccattattggagaacaatccgctggtttcggcacctacaccaatacctgatgtagaataatgtatatgttaactattaaaaatatggaatatgaaatatataaataagatacttagtctgtttgtcatcgcactgatagctacctcttgcgatcctgatgcagaaagttatactccgggtgaacaggaagacggtaatcaaggcatctgctttgtgggcaattacacccaaacagtggaagttgagccgggaataacctcttttgatttaaccttgacacgcgccttgacagatgctgtcggtacggttgatgttactgtgataaataatgaagagaatatatttatatgcccttctactgtatcattcgctgctggagagaaaacagccaagttgacagttgaagcaccatcagctgctgagggtatcacttataatctacagctggctttgagcggcaatgatgtcagtaactattcctccggataccatgaaatatcagtgaattttgctattttgaagtgggaatctatcggtaccggatactacttggatggtacagtttccaatttctttaaagtagatccgtctgttccgatggctgtggaaattgaaaagactacaactgctaccagtacacgtttccgtttcgacagcccgtttgccaaagttgcgaccgcacaagatgaggttggtggtttcaacggttatccctttaatgaagaggctgatatagttccaggtgaatatactttcgtaattgatgtgactaaagaaggcgcttctttgaaaccaattcaatatggtatggattggggatatggtatgttcagcggtggttctgtatatggcaacttatctactaatataaattcttatcctttgggagtttataatgaaaaggccggtagtattaccttcccagccaattcgttgtacgtaagtatggctgactatcaagacggtggtgcatatccttgtaccaacccgtcttatctctacttgagtgcggaagcataccttaactctttggagacagagtaatttgaaaattaaaaaaattacataagaaaagccggttcacacaaggggccggctttttactttaaatatcgattcgcagagattgaatcgttaatttacagtttttccttatcctctgccaacaaaaagtttcgcagtgaaatctgtttaattcctttgtaatttcccccgctttgcatttcatccattgttaccacatatttggggtaattgtctgctatttccaaaagattgccaaattctcgcctaacagttgcatcatcgggaagcatatatgctacttgaatatagattttatggtcgtctttggaagcaatgaaatcaatttccttattaccactctttccaacatatacttcatatccatatcttaacaaatcaatgcatactacattttccattaacttgttgatgtcttttcgaaaatcgaaatgctgtatggaattatgtaatcccaaatcttcaaaataatatttctcaccaatctcaaagattttcatcccttggatttcagctcgttgaattttgtaaataaagaaactattgcacagtgcctttagatagttcagaattgtctgcgtaggaatgttgacgtgttgcgactttaaatatttactaatattctgggcagaaaaaagagaaccggtattatctatcagataagctacgagattttccaaaaaagatacattccggattgattcacgtgcaaccacatcttttagtaggatagtggaataaacgtttctcaaatactcaaatatgacattcttgtccattgttagattatgaatgtagggcatacctccgaatgtaagatagagttttaaactttcggtggaatcttgacattgattgaaagttaagaattccccgtagctaagtgaatgaatgggaaattctatatatcttcctgccaactgagtagcaagttcactggatagcattttagcattacttccggtgcaatagatatcgcatctattttcattcaataaactccgcagacacaattggaattcttcaatctcttggatttcatctacaaagagatagttatgattatgcccaataaccttctttaaaacatattgataaagatccatgtagttcctaatttccgtgaaggcaagttgctctttatctacaaaaatgatattggcttccggtatgtttttctttatgatatctgatatctgcaaaagaatgtagcttttacctatcctacgttggccggttattacttttattatacttttatcaataaacggttcaattctccttatgtataaagggcgggagatataatttttcatattcaaacacgatttagtttatgcacaaagatataaaatcattcaattataattgaatctttccatacatattatatattcatcgattataaataacatatgtaaaccaaatatttctcaacaaaaaatattttggaactttcatggataaaatctatctttcaaaatatattcctctatataatctatcgttattcttgaataaaaaacatttattgggttaattagtacatcaccaattaaaagagtagaatgaaatgttacaataacgtgctcattatcagcttttaattattcaaaacggtatgaaatgggtactttgagatacttacctccctttgccatatacctttatagataatatacaatagaataaaccctgttctacggcaaacataaacagttgtttttcaacaatatacaattattatagttccgcgaaaactctggtaatttcttatattggtatgcaaacccaggaggtgacaataaaacctagcgtaaaagtggtgatgaagtctgatacagagatgcttgatgaggtaatggtagttgctttcggtacagcaaagaagtctgcatttacgggttcggctaaggtgataggtacggaaaagctggagcagtcgcaggtgacaaacgttaccgatgctttggctggtgctgtgccgggtgtgacattgacatccaatgacggtgctcctggttcaaagtcatccatcaagatccgtggtttcagttcactcaatgcaggaaacgaccctctgattattgtggatggtgctccttatagcggtgatatcaataatatcaatcccaacgacgttgaatcaatgacggtattgaaggatgcggcttccaatgctctttacggtgcgcgtggtgctaacggtgtaattatcatcactaccaagaaagccaatatgtcgggtgaggccaaagtaactttcgatgccaagtggggagcaaatacccgtgcgttgcagaaatatgacgtgattgacaatcctggcatgtactatgagacgcactatgaggcaatgaaaaactactataaatatgaggggggaatgagtgatcaggctgcatggcttgaggcaaataacaatttgtttggctctaacggtggcttgggttacaatgtctatacggttcccgaaggacaataccttatcggtcagaatggcaagcttaatcccaatgccacattgggtagagttgtgaattataaaggacgcgactatctgcttactccggatgattgggacgatgtaggtatgcgtaccggtttacgtcaggaatataacttctcagtgagcgcagctaatgaaaaatcttctttctatgtttctttaggctatcttggaaatgagggtatcactgaaggttctgacctgaaacgtttgactggccgtttaaaagccgactatcaagccaagaagtggttgaagatcggtggtaatatggcatatgcgcgatttgattccaattcattgagtaataatggttccagtagttctcaaggtaatgtatgggcatttattacccaaatggctcccatctatcctgcttacgtacgtaatgctgatggcagtatcatggttgataagaatggtattggaatgatggactacggtagcggtatcaatgcaggtatgcaacgtcctttcattcctgatgccaatcctattctggacaacaaacttaacacccataatgctgaaggaaatgctatcagtggtaatgcttttgtagacataactcctatagaagggttaaaggtgacattcaatggtactttcaacttggatgagacacgctttacatatgtttataatccttattatggacagttcgattctaccggtggtacagtaagcaagagccatcagagaacttacgactacaacttgcaacaacttgtctcatatgccaaatcattcggaagcaataatttcgatattttgttaggacatgaatattatgactaccgcctttcttatttgggagccagtaagtcacagatgttctctcaggacaatcaggaattggatggtgccattatagatggacagagtgcttcttcatataagagtcgtcgtaacaacgaaggcttcttcggacgtttgcaatacaactatgacgaacgcatcttcggctcagcttccttgcgtcgtgatgcttccagccgtttccatccagaccaccgctggggtacattctggtcggcaggtggtgcatggctcatcaacaaagaaagctggtttgatgcttcttgggtgcaggaactgaagttgaaggcttcaatcggttcacaaggtaacgataacatcggtgatttccgctatacggatagatttaatattattaattccaataatagtctcggcacttcgttctactctaaaggtactaaggacatcacttgggaaaccaataccaatttcaatatcggtgcggaattccaattgtgggaccgcgttaccggtagcatagagtactacagacgcaagacttcagatatgttattctcattctccgtggctccttcattgggttattcttcttatctggacaatgttggtaacatggtcaatagtggtgtagaaatggatttcaatgtgaatatcttcgatacacgtaactttacgtgggacgtaaatttgaacatctcaactttgaagaaccgtattacgatgcttgatcctgacaagttgattactactgagtatacagctgacggaaagggatataagggttattctaacggaagcttcttcattggtgaagatttgtctatgtttacatggcgtatgaaggaatatgccggagtggacgaagagggaagagccttgtattataagaatgttaaggatgaggccggcaacatcaccggacgcgaaacgacttggaaccatgctgaagctgactattacatcacagaggaaagcacgatgcccaaggtatacggtggtttcggtaccaaactgaaagtatatggtgtagatttcggtattaacttcacttaccagattggcggcaagcagtatgatggcacgtatgcatactttatgtcatcacccaaaggcacggcaggttacaactatcacaaggatatcctaaagtcatggactcccgagaacaccaacactgatattccgcgtttcatgatgaatgacccttcatatccggcttcatcatctacacgtttcttgactgatgcaagtttcttgaatatccagaacataaatgtgggctatacattgccttccaagtggacaaagaaactggctataagctctttgcgcgtgtacatgtcggcagaaaatgttttctactggtctaaacgtaaagggttcgacccgcgtcaatcatatgacgagacgaccaacgctactttctattcaccgatgcgtaccatctccggtggtgtgtcattcgagttctaaaactaaatattatagataacaatgattatgaagaaaaatatattcaagttgttttcagccatggtggtatcggctacagtactaaccggctgtatagaagaggtttttcccgaagattctactgcgacctccgagcaaatcggtgcgtcagctacggcacttgaggctgcagtcagtggcatgccgtcacaaatggtacaaggctatctggtgtatggtagccagacccatgaaaccgaccttggctatccttcgctgatgttggcacagtctgaattgttgggcgatgtagtggacacagactatgggtatgactggtggtggcccttcaatgcaagcttgcagatgtatgacaatggttattactcatatttgccttactttaccctatataagttcgttaaatcggccaatgacgtgatttcagttgttgacgttaccgatcccacgattaccgatgagatacgtggactcggcagtatatcccatgctttccgtgcgtttagctattatacgctgatggtgcttttcgagccagtagagaatatctatactgattgtagcaaggtgttgggactgacagtgcccattgtaactgaggaaacaactaatgacattgcgaagagcaatccgcgtgcgactcacgaagaaatggtgaactttatcctttctgaccttgacaaagcagagataggtttggagtcttatatacctactagcaagaattttcccgacttggctgtagtatatggtctgaaagctaaggtatatatgtgggatggccaatttgataaagctgccgagtatgcccgcaaggctattgataagtcgggtgcaactcctatgaacgaagcacagtggcataaccccactacaggtttcaatacggctacttctgcatggatgtggtatcttcaccccacagcttccaacatgggtaaccttgctaatttcatcggtcacatttccaatgaagcggattggggatatgcttctttgtctaaactccaaatggcacgttcactttatgacgcgattcctactaccgatttccgcaaatattcttaccttgacccggacagatctgtttacgcttaccagtctgtgagaggcaatgagtggttggacgaacagccggattatatgtcattgaagttccgtcccgtgggcggtgactatagcacttattctgtgggtgcggctgctgatattcccgtgatgcgtgtggaagagatgtatctcatagaggctgaagctgtaggtgccagccagagtgtggcagcaggtgtacaactgttgaataactttatgaagcaaaatcgtcagtctgattacagttttaacgcaggcgatttgcgtagtttccaacttgaggtcttgaagcagatgcgtatcgagttttggggagagggggttgcattccctactgccaagcgtttgaaaccggatgttattcagcactatgagggtaccaattttaaagaagataacttcaagatcaactgtaaaggtgtgaagcctaactggacgctgatgatccccaagaccgaggtggattcaaatatcgcgcttcaaggaatgaacaatccggacccgaccggtgctattcctaagcgtcctactccgataggagagtttgcgcctggtaacaattaaattaaatgaactaactttataattgaatttgtatatgaataagatatttaataaactgttttgggtcatggctgtatgcggcttgacaatgacggcttgttcagacgatattgactggaatcccggtgctgctgccgatggacaaggggtcttcttcccttcgagtcaatcaagcagtataacgctgaccgagacgtctggttctttcgaggtaagtgtatttcgtacagtaagttcaggagcctccaccacacaaataactgttactcccggtgagaatgctgctggcatttttacagttcctaccgaagtaagctttgctgatggtgtgacagaggcaaaaataacggtgacttaccagaatatgaagcgtgatgtcccctatactttgaccctctctgcagtggacggcactccgtatggcattactgacttgacgatcagtgccatttgtccattagtttgggaagtggtaagtactaatgccacattgatagacaatatgtttgaggcatttggtgctaccggtgttaaactgaccggtattacggtggaaaagcatcccgaacttaacaaatatcgttttaagagtccttatgacaattcttattttaactctttgtttggcataggaactcttcttcctgatgattttaaacttccttatattgagttggacggtaatacttatccgggtggatattatatcactgttacaaaattgggatggaaaatggtaaatggtgtaggtcctgaggccaatagcgattggggaactttcggttctgtttatggaaatctttccgaagaccttggtacttatccattgggaagctacaacgatgctgagaaggtatttgatttgggagctctcttcttttgtatagatgacagtggctctgaattaaattatcctcttaagggtacaactttgctgtatttgaacaactgatttttgtttgtattccgtgtgatacggaacttatgaatgtggagggtgaattataatagaattcatcctccctttattttatctctctttctaaggagcttccgctaaaattatatatatttgctgcccgaaccaacaatatatataataaggtatagaaactatgaaagaatttgtaatctccgaagtgcgggcagaaacagcggtattggtaggtcttgtcacgaagactcaggatgagcgtaagaccaacgaatacctagacgagcttgcattcttggctgagacagccggggcggaagtagtaaagcggtttacccaaaagctggaccaggcgcattccgtgacctacgtcggcaagggcaagctggaagaaatcagagagtatatccggaatgaagaagaagccgaacgtgaagtcggcatggtgatttttgacgatgaactttctgccaaacagatacgtaacattgaagcggagctgaagattaagatattggaccgtacttcgctcattctcgatatttttgccatgcgtgcccagactgccaatgcaaaaacgcaggtggagctggctcaatacaagtatatgcttcctcgtctgcaacgtttgtggacccacttggaacgccagggtggtggctccggtgccggtggaggtaaaggttccgtgggacttcgcggtccgggtgaaacgcagctggaaatggaccgccgtatcattttgaaccgtatgtcattattgaaggaacgcttggctgagattgacaagcagaagtctacccagcggaagaaccgcggacgcttgattcgtgtggcattggtgggatataccaatgtaggaaaatccacattgatgactttgctttcgaaaagtgaagtctttgccgagaacaagttgtttgccacgttggatactacggtgcgtaaggtgattattgagaacctgccgttcctgctttctgatacagtgggctttatccgtaaattgccgacggatttggtagactccttcaagtctactttggacgaggtacgcgaggcagacttgctgttgcatatcgtagacatctctcatccggattttgaagaacagatagaagttgtgaacaagacgttggcagatatcggtgccgccggtaagcctatgattcttgtattcaataagatagacgcttatacctatatagagaaagcggctgacgaccttacccccagaaccaaggaaaacttgacactcgaagaactgatgaagacgtggatggctaagatggaggataactgcctctttatttctgcccgcgaaaaaatcaatatggaggaactgaagagtgtggtttatcagcgtgtgaaggaattgcacgtgcagaagtacccctataatgactttctttatcagacctacgaagaagaagtttaattttagttatgagtgataagttatgagttatttgctggcagcggtttgaatcggtagtgccggcaaaggcaataacttataactcataattcataactcgttataaggatgaattacagaagactgaccgaagatgaaattctccggttgaagagccagtcatgtctggctgatgattggggaaaagtagctgttgcagaagagttctcaacggaatttgtgcatcatacccgtttttcgggtgaggtgcgtttgggagtgttccattcagaatttatgttgccgggaggaatcaggaagcattccggtttgcggcatgtgacgctgcataatgtaacggtgggagataactgttgcattgagaatatccagaactatattgccaattatgaaatagggcatgatacttttattgagaatgtggatattattctggtagacggtgtgtcgaagttcggtaacggggtagaagtgtctgtcctgaatgagacgggaggccgtgaggtgctgattaatgataaactctccgcacaccaagcctatattctggcgctttaccgccatcgtccggaactgattacacggatgaaggaaatcacggatttttattccaacaaacatgcttctgctgtaggaagcatcgggaaccatgtaatgatattgaacaccggttccataaagaatgtgcgcatcggtgattattgccgcatctgtggtacatgccgtctgtataacggaagcatcaacagcaacgaggtggcgccggtacacattgggcatggggtgatttgcgatgattttatcatctctaccgggtctcatgtagatgacggagctatgctgagccgctgcttcgtggggcaggcatgcaagttgggacacaactactctgcttcggattctttgtttttcagcaactgccagggagagaacggggaggcgtgcgctatttttgccggaccttatacggtgacacaccataaatccacgttgctgattgccggtatgttttcctttatgaatgccggttcggggtccaatcagagcaaccatatgtataagttagggcctatccatcaaggcactttggagcgtggtgccaagacgacttccgattcgtacatcttgtggcctgcaagggtgggagcgttctccttggtaatggggcgccatgtcaaccattctgatacttcgaacctgccgttctcttacttgatagagcagaataatacgacttatctcgtgcccggtgtcaacctgcgtagtgtgggtaccatccgcgatgcccagaagtggccgaaacgtgacgggcgtaccgacccgaacaaactggattacatcaactataatcttctcagcccctacacggtgcagaaaatgttcaagggacgggaaacgttgcagaatctgcgtcatgccagtggcgagctttcggacatctattctttccatagcgcgaagatacgtaactcggctttggtgaaaggcatccgcttctatgaaatagccattcataagtttctcggaaactctgtcatcaagcgcttggaaggcattgacttccggagcaatgaagaaatacgtgcccgtttgaagcccgatacggtcattggcagcggcgaatgggtggatatttccggattgatagccccaaagagtgagatagatgcgctgatagacggtattgagtccggcaaagtcaatcgcttgaagtctatcaatgccgagtttgagaagatgcacagcaactactacacctacgaatggacctgggcgtatgagaagctggaagagttctatggtatcaggccggaaggtatgacggcggaagacgtcatacatattgtcgaaaaatggaaagaagcagtagttggcctcgaccgcatggtgtatgaggatgccaagaaagaattttcactggcttccatgacgggctttggagccgatggctcacgcttggaaaaggaactcgactttgagcaggtacgcggcgattttgaaagcaatccgtttgtaatggctgtactgaaacacattgaggtgaagacggcgctgggcgatgaactgatagggcggatgcagcgggtatcagaaaattaattatgatttgttgcgtttttactctaattaaagaattatttcaataatagtttttacctttgctcggtaaaggcggttttgtgctgtctttgctacccgaatcacttttaaacattaaatatacgagtaattatggcaacaacacctccgttcaagtatcaacccatgttcgagaagggaaaagatactactgagtattatctgcttacgaaagattacgtgtcagtaagcgagtttgaaggaaaacctatcttgaagattgaaaaagaaggtttgacggcaatggccaatgcggctttccgtgatgtatcgttcatgttgcgtcgttcgcacaacgagcaggttgctaagattctgagtgaccccgaggcaagcgacaacgataaatacgtggcactcaccttcctgcgcaatgccgaggtagcatccaagggggtacttcctttctgccaggatacgggtacggcaatcatccatggtgagaagggacagcaggtatggaccggctactgtgacgaagaagctctctcactgggtgtttacaagacttataccgaagagaatctgcgttattctcagaacgctcccctcaccatgtacgatgaggtgaatacgaagtgcaacctccccgcacagattgacattgaagctacggaaggtatggagtacgagttcctctgcgtaaccaagggtggtggctctgccaacaagacttatctctaccaggagacaaaggctatcctcaaccccgaaacattggttcccttccttatctcaaaaatcaagactttgggtacggcagcttgtcctccctatcacatcgcattcgttattggcggtacctctgccgaaaagaacttgctgactgtgaaactggcttccactcacttctacgataacctacccactaccggcaatgaattcggccgcgctttccgcgatgtggaactggagaagctggtactggaagaagctcataagattggcctcggtgcccagttcggcggcaagtatctggctcacgacatccgcatcatccgcctgccgcgtcacggtgcgtcctgccccgtgggtctgggtgtttcctgctctgccgaccgtaacatcaagtgtaaaatcaataaagaaggtatctggattgaaaagctcgacagcaacccgggtgaactgattcccgaagaactccgtaaggccggtgaaggcgacgtggtgaagattgacttgaaccagccgatggccgatattctgaaggaactgaccaagtatccggtttccacccgtttgtctctgaatggaaccatcatcgtaggccgtgacatcgcacacgccaagctgaaagaacgtctggaccgtggcgaagacctgccgcagtacatcaaagaccatcccatctactacgccggtcctgccaagactcctcaaggcatggcttgcggctccatgggcccgactactgccggacgtatggacccgtatgtagacctcttccaaagccacggcggcagcatgattatgcttgccaaaggtaaccgcagccagcaagtgacagatgcctgccaaaagtatggcggtttctacctgggctctatcggtggtcctgccgctatcttggcacagaacaacatcaagagcattgagtgcgtggaatatcccgagctcggtatggaagctatctggaagattgaggtggagaacttccctgcatttatcctggtggacgataagggcaacgacttcttcaagcaactgaagccctggaattgcagcaagtaaaacagaagccttttagaaaggcataatataaggaaagccgtaacggagaaaatcttgttacggcttttttgttttgtagaggaaaacaaagtgtttcgcggcatagaacactctgtttcatcaagcaaaacaaactgttcctttatgttgaaacaaattgtttcttcctattgaaacaaactgttcttttatgttggaacaaattgttcttccctattggaacactctgttctgccttgataaaacagattgttctctataggagaataaaactgaaactcgtttgttgtcgtatttttgttacattctccttttcatttctcggttaacttctttatctttaaccctccaaacaaccaatttaataaaacatggaaccaactcttacacgacaaactccggcacaacacatcgtatggctggatgtggtacgccttgttgcaatgtttacagtagtttgctgccattgcacagacccttttaacttctatccgggcacatcgcccgacattgttgacatcaagttctggggagctgtctacggtgcggcgctccgtccttgcgtaccgctttttgtaatgattaccggtgcattgctgttgccggtacggggtgacgcctcggcattctacaagaaacgtatcccccgcgtattctttcctttcctcatctggtctgtgatttacaatctgttcccctggataacgggactgctgggagtggatccgaaagtgattctggatttcttcccttattcgggtgaggaagtgatgcgccagtctctggcagtgagcctgggatatattgcagaaatgccttttaatttctctctattggatgtacacatgtggtatatctatctgctgatagggctttatctctatcttccgatattctcggcatgggtggagaaggcctcggaacgtgccaaactatggtttcttgcagcatggggagtgacactgctgctgccttattataccgagtttgccgctccgtacctttgggggacttgctcgtggaactcgttcggtatgctgtattactttgccggttttaacggctacctgttgttgggccattatctgaggaaccataactggacgggccggcaactctgtggcatcggcattcccatgtttgccattggctatgtcgtgacattccttggtttccgtcgtatgacctccttgccggattttacggatgagatgctcgaactcttcttcacctactgttcgctgaatgtagtaatgatgaccatccccgtgtttatgctttgcaagcgggccaatttccgttcggagcgcatcaagaaagcattggcaaacttgacgctctgtggttttggagtctatatgatacactatttctttaccggaccgagcgtagtcttgatgcgtgctatccatgttcctatctatcttcagataccttgtgccgcagtcgtcgctttctgtacttcctggtttctggtggcaatggcataccgttgtttcgggaagcggaccaagtgggtgctggggtagtttggatgaaagattgtttatctttaaaggaggagatttagggcttattatttcctccagattctccacatatagtaagcgcagtgcgtgaatgcgaaaacaaacgagataatcagcagcactttgctttctccccatcccacagtctgttggtgccacagtccggtgatgacacaaagaacggcaaggataagtccaatcatgttcaaggccacctgcccgtggcgggtggcgcctccatgctccagcttactgtgcttcatgccgtagcccacgtagatgtccaggccgatgagcatccacagcaccaggcgtatccatgtatcggcaggaaggaacaacatcatgcaaaggcaagtaagaatacccagtatggggataagtggaacaagtggggttttaaaggaacggggcacgtcaggcatggttctgcgtactaccagtacagcggcacagaccagcgtgaaggccatcagcgtgccgatgcttgtcatctctccggccagccgtgcgggtgcaaaagctgccagcaggcccacaagtaccatgaagagcaggttgctgcgtgccggagtacggaacttttcgttgatatgcgagaagaaaggaggcagcagcccgtcatggctcatgcttaggaatacgcggctctgtcccagcagtgtcaccatgatgacggagcaatatccgaacagaatggacagcacgatggcacggttcagccagggatagtccggctggatgatacctgcagcatcagcctgccccatgtgctctatggctatggcaacgggagcaatgccttgctgtccgctgaaggcggtgtagtgtgccactcccgtcatgacgtgggcaaaaaccatatagagcacggtgcataccagcagggagaccagaatgccgataggcatgttccgcttcgggttcttcgtctcttgggcggctgtgctcacagcgtcgaacccgaggaaggcgaagaatacgatggccgcccctcgcaggatgccggagaagccatattcgcccagcacgcccgtattggcagggatgtaaggtgtatagttgtcggtattgatgtatttccagccgagtatgacaaaaatcagtatgacggaaaccttcaggaatacaatgaagccgttgaagatggagctgccttccgtaccccgtatcaggaagaggctcatcagcacgacgataaggaaggcggggatatttacgactccgccatcccagggacaggcggtgagggcttgcggtagatgtatgtccagtccctcgagaaagacgaccagatagcggctccaactgatgcttactgtggttgcggctacggtgtattccaataccaggtcccacccgataatccaggcgatgagttcgcccatcgtggcatacgagtaggtgtatgcgctgccggctacgggtatcatggacgcaaattccgcataacacagtccggcgaagcagcatcccagtgcggcaatggcaaaggacagtgtgatggccggtcccgtatagcctgccgccaccgttccggtgatggagaatagacccgctccgatgatgactcccacgcccagggcaacaaggctccacggaccaagtacacgtttcaatgttttctttccggaggcattagcctccgcttgcagtgcctcgaatggctttctgatgaataatcccattatgcttcaattctgataaatcgggcgcaaaggtacggattatattgcttattccatatagcgcgctacttttccactgatttgcagtagggagatttcacataatttggtatcatattctgcggagagaatacgttcttctgcatccagcagactcttttgggcttcgcgcatctcgattcccgagaggttgcccagcatatatcgttccatggcaatctcgtggttctccttggcagcgacaaggttctggcgttcaaggttcagcatttgcaggttgttttggtaggcctgccataggttgctgaggtcggcgcgcagggcttgctccagttgctcccgttccaggcgagcgttctgcacggcaatgcgggcattcttgcgttcgcggcgccggttgccgtcgaacagattgaagccgaccgtgacgccgaagttcagaccgaggttgctgcggcggctgttggcagagatgtcatacttgttgagggtgtagccgtatccgccgttcatcttcacgtatgggtagtcgcgcgagcagactttcttgtagtccagacgggccagggtattgttctgttcggcacgtagcagtgaggcgttgatggcgagggtggcgttccacagctcctcgaagttcagggaggcggtcacgttgatgaggctgtcttgtatgataaacggctggtctacatctttgtttgccatgagttcgttcagctggatacgtgaggtgtgcagcagttcctgctgtttcatgtattgggcactgtcggcattgaagtccactttggcctgctggtagtccaggcgcgagaagttaccgatgtggtaacgctcttccacaatgcgcaggcgctctttggatagcgatacggcataacggaagttcttcaagcggattttctgctgcacatagttatagtattcggcggctatgttggctatcaggtcctcgatggcgatgcgcgtattggtctcgccttggcgttccagctccttgagccgttggtagttggcggtaatgttgaaaccgtcgaagatggtccagttcaggttgatgcctgcatcgagagtttggtcaaacactccgttgtccttggttgtctctccggtggctcgggctttggtctcggtattgtctatggttcccttgtagccggcggagaggtccagtgtgggcaggtagcccgcattgcccagtgtggcgttgttcttgctgacctgctcttcattgcggacaatgcgcagggagtagttgttcagcaatccctgctccaggcaggacttcaaggtgtaggtaggcgcaggctgtgcataaaggcccagcgctgtgcaggcagtggctatgaaaattaaaacaatgcgtttcattcggtcttcagtttacttcggttcgttgatacataactatatatggcaggcacgatgtacatcgtcagtagtgtggagatgagcatgccgcctacgacggcagtacccatggcgatgcgctggttgcagccttcgccggtggcgtaggcaagcggtatcagtcccaggatggtggaagcactcgtcatcaggatggggcgcagacgttgcagggaggcgtccttgatggctcgcatcttgtcttcacccgcttcctgcttctgattggcaaattccacaatcaggataccgttctttgccaccagaccaatcagcatgataataccaatctggctgaatatattcatcgtaatccccccgaaatacatgaacaccagtgcgccggcaatggcgagaggcaccgtcaacatgataatcagcgggtccttgaagctttcgaactgggcggccagaatcaggtaaatcagcacgatggccagaatgaaggcgaacatcagactggaggaactctccctatactctttggagtctccggtcagtgcggtgcggaaggtctcgtccagcgtctccttggcaatcttgtccatttcatccagaccttgtccgatggtcttgccgtccgccagtcccgcggagatggtggcagaaacgaaacggttgtaacggtacagtttcggaggtgcgatgccgccggtaagctcaatcaggttgtccagctgtaccatgttcccgttgtcgcttcggatatagatgcctttcaggtcggcgggcttgttgcgttgctggcggttgatttcgcctaatatctcgtattgctttccgttcatgtagaagtagcccatgcgctgtccgctcaagccgtattgcagggtttgggcaatgttcttggtgcttacgcccatgatgctcgccttgtcacggttgatgttgatgcgcgcttcaggcttgctgaacttcaggtttacgtctgccatctggaataccggattttcgtagaccttcgtcatgaacttggggagcacctcctgcaatttctcgatattggttgcctgcaatacatactgcacgggcataccgccgcgccgtcctccgaatgaggaggactgctgtacgaaagagcgtgccatggtctttttctgcactgccttcgacaacttttcggcaacctccatctgggtatagtcacggtctttcatgtctttcagtgtgatacgtacgttaccgctaccactggacacacgcgccgtgaccgcttctgcatccgggataatggagtccaccagatgattgatgtcttcggtatagtcgcggatatattcgtaagtcactccttcggcacccattgtattgatactgatttgcgaacggtcctccaatggcgccatttcagccgggatagtattccaaaggactccgataagcaggatggtgacgatggtgaagggcaaggcaatccagcgccgtttcaggaaggcagccagtgactggctgtatacccggttcatcccttcgaagaaaggttcggtcttgcgatagaaccagctctgctgttcccttttgattaaaagtttggtggcaagcatcggcgtaaaagtcaatgcggcgaaggaggagataatcaccgaaccggagaccacgatactgaattcgcggaacagtcgtcctgtcgtaccgtccatgaatacaatagggaagaataccgccaccagcgtaatggtagtggagatgacggcaaagaaaatctccttggctccttctatgccggcttctttcggtggcatccctttctcgatgcggacataaatgttctccgtcatcacgatggcgtcgtccaccaccaagcccacggcaagcaccacggcaagcatggagagcacattgatggagaaaccggccagatacatgacgaagaaagctccaatcagcgaaacggggattacaatacatggcacaagcgtcacacgccaatcgcgcaagaagaggaaaatgatgatgataaccagtacaaaggcctcatacaccgtctgcttcacctcgtcgatagaagcgcggataaacttggtattgtcaaaaccgtagttgtaatgaacatcttcgggaaggtctttcttcatcttctccatgcggtcatatacggcgttggctatttcaatgtggttggcacccggctgcggaattactacgacacctaccatgggcacaccgttcatcttcatataacttttgatgtcggctggtcccagttcggcacgtccaatgtcgctgaagcggacaatacggttaccgtcttccttcaggataagattgttgaactcttcggctgtatgcatcagacccaacgtacggatggtgagctcggtagtgtttccttcgatacttccggaagggagctctacgttttcgttgtccaccgcattctttacatccaggggagtgattccatagccggacatcttgatggggtccagccaaagccgcatggaatagcgcttttctccccagatgcttacactacttacatctgaaatagtctgaagctgctccttgacagtcaggtcggctatttcactgagctccagtagggaacgtttgtcactttggagggcaaccatcaggataggggtggcgtccgcatcggcttttgatacggtaggcgggtcacagtcacgaggcagatagcgctgtgcacgcgacactttatcacgtacgtcgttggcggcggtttccaggtcaacggaaagctcaaactctactgtaatgcgtgatgaaccttgctggctgacactggagagggagcgtatgccgggaataccgttgatgttctgctccagaggctccgttatctggttctcgatgacatcggcgttggcacccggataggagcaggatactgatatgatgggattgtctacagacgggtactcgcgtacacccagataattgtagccgatgaagccaaacagcaggattatcagggtaagtactgtcgagagtaccggtcgccgtatacttaattcggatatattcattctttacaattgataattaacggttgataattgacagttgtcaattgatattgtccagtgttaccggtagtccggtacggagttgcagggttcccgaggtgatgatggtatctcctgcctgcaagccttgcaatacttgtacttccgcttccgtacggattcccgtagtaatctctaccggctgggcttttcccgacttatagaggaatatcttgtcttttcccatttccggtacaatggcttcggacggtacggcaagggcgtcctgaatttcatccttgttcagcttgatgctggcatagcggcccggaagcacagctccgttggcattgggataaagtgcacggattgtcagggtatgggtagtagggtctatctttgattcgcgtgcataaaccgtggcgtggaaggtgtttagctttccttcgagagtgaagtccagtccggcgccggtctttacgtcattggcataccgctcgggtacggcaaattccaccttcaacggcgaaatcttggtgagtttggctacaatggttgtaggggaagcgtaagtacccacactgacttggcgcagaccgatgacaccgtcgaaaggagcacgcagctcggtttgtgcgatgttcgattctatcaagtcaatgtcggcattcagggtggccagctcggtctttacttgttcgtaggcttctttactgaccgcatccctttccagcagggcgttctggcgaaacacgcggtcttccgccaactttaattgggagacgaggcgttgcaattgtgcttgcagcggccggtcattaactttggcaagtaattgtcctttcttgacgaagctgccttcttcaaaatttatctctatgattttgccggatgtctcgaaagaaaggtccacttcctcatccggcagcaggctgccgctgatttgtatttcatccttcagcagttgcggtttgattatttttgcgtttacgtttagaattttcttaccgctacgttgaccggtcatcaccttgtctgcagcggctaattcttcattctctttaggtaattgggagtagattcctcctccaatcagtccggcaccaatcacgataatgatgccccatttaactctcttattcatgttgtagtattagtagtaataaaatcagccttagattagactacgggaaaagagaatagtttaaaagataaagagttaaaaagtgtaagaatatggattggaaaggtgataaaatgacaaatcagtaagcagcccggtattttccctcctccttgtcctccagcatattcagataagaagcgtaacgggattcgctgatatagtgcttctcgacagcctcgcgtacagcgcattcgggttcgtggcggtgggtacagttgccgtaacggcagttggcagataccttgaatatttccgggaaatagtggcctatttcttcttcttccatatcgaatgttccgaaacctttgatgcccggagtgtcaatgatatatccgtcaccgggaaccgggaacatttctgagaaggtagtggtgtgcatacctttattatgataggtggatatctctccggttttaatctctatatcgggcagtattgccttgatgagtgtcgatttccctactccggaatgtccggaaaagagggttatacgtcctttgagctcttcctcgataatatcgatgccttcctcttttttggcagaaaccttgaaacatggataaccgatggtggtataaaggttgatgagactgttcagatagtgcagttcctcttcgttgtaggcatccactttgttgaatataatcttgacgggaacacggtatgcctcggcagaggcgagaaaacggtctataaatgtggtggaggtttcgggatagttcaccgtcactatgagcatgcactggtcgaggttggcggcaagaatatgtgattgcttggaaaggttggaggcacggcggatgatgtaattcttccggtcctctatctcgctgataaaggccgtaccttcctggttcagtatgatgttcacgtaatcgcctacagccacgggattggtgcttcgtatgcctttcaaccggaagttccctttgattttacattcaatctcccttccgtcgtcagtccgtaccaagtaccagcttccggtgttttttataacgagtcccctcaaaataattgataattgataattgataattgataattgataattgataattgattgctggataattaactataggtattattacacatgataattatcaactgtcaatcatcaattatcaattcattaaacggtcatgatttctttatcctttgcagccagcatgtcatcaatccgcttgatgaacttgtcgtgaatcttctgcagcttttcttcaccgcctttctgggcgtcttctgccagtccgtcctttacggatttcttcaaggcgtcgatggcatcacggcgtgcattacgtacacttactttggctgtttctccttctcccttgcattgtttggcaagctgcttccggcgttcttccgtcagcggtgggatgccgatacggataatttcaccgttgttttcgggcatgatgccgagactggagtcaatgatggccttttcaatgacgcggaacatgctcttatcccatggcttgatggcaatgctgcgtgcgtccggagtggttacggctgccacattgttgataggaaccatacttccgtaagaatccacacggataccatccagcaaacggatatcagcttttccggcgcggatatgagccaatgcctcgtccagatacatgatggccatgtccatactttcttgcgcttcgtctaagatgtcttttacgtctctcatattattttcgtttttggaatagctttaatttgaaactttgcaaatataattattaaatcgggaattgagaattaagaattaaataacattcatttttttattctcaattcttcgttttccgtttttaattcaattatgtaccagtgtaccgatttcttctccttgcatcactcttttcagattccccactgtatccatgtcaaaaacgatgatgggtaggttgttctccttgcacatgcaggtggcggtgaggtccatcactttcagaccgcgcttcagtacttcgtcgtaagtgatgtcgtggaatttcgtggctgtcgggtccttctccggatcggcggtatagatgccatccacacgggtacctttcaacatgacatctgcctcaatctcgatgccgcgcagactggaaccggtatcggtagtgaagaacggattgcctgtaccggcggacatgatgactacttcgcctgcttccatacattcgatggcacgccatttattgtagaattcaccgatgggttccatacgtacggcagtcagcacgcggaccttcacgccggtagctgccagagctgaactgagggcaaggctgttgatgacggttgccagcattcccatctggtcgcctttcacgcggtcgaatcctttgtgggcaccgttcaatccgcgaaaaatgtttccaccgcctatcacgatgcctatttgtactcccaattcgtggatttctttgatttgagctgcgtactcggcaaggcgtttttcgtcaatgccgtattgcttttcacccatcaggctctcgccgctgagcttcaataagattcttttataggttgtcataatatatagttttgttatatttctttgcagcaaagataaagaataaaactgaaaagtgctgcagaatgaggtaggatagttgcctaacgtattgtctttaggaactcgtccatgctgtgatataacggaataccataatggttacaagtaattcgcacattgtcgtagcggtagaagccgggctcgcagatgacgtgcagtttgccggaacgcatgtgcagccccatctccagcagagtgatgggagacttactgcttgccaggatattcatgattatcaggtcggctttttccagatgttccagttcccagttcacttgatgttcaaagtcggacatttcaccgctcaaccccttgtcccttcgggggttgtataggagatatttgccttcgggacgtgctcggaaccagtcgcaggttgccttttgccagtctatgctcttgcccatgtcaatggtcccagccaggaaaattttggtatattcagcttcgttcacttcggctttgtcttcatccggacggagtacgatcacctcggactgagcttgtaggccgatagggaataacagaactaaaagcaggtagagattttttttcatggttgatgatggtttatagaattagttgtttttcttgctctttatcgggagtcttggaaacagtttcctgaaacgaaccagttggcctgtaatgtttccccctgcgatgacgagcgttacggctacaataatcatcaccagtccgatgctttctctgacagtcaagctttctccaaagacagctattccgaagaagatggctgtcacgggttccaatgcaccgagaatagcggtcggggtggagccgatgtattggatggctccagtagtgcagaggaaggatatggcggtgggaaagacagccagtgcaagcaaattgccccacagataccactggtccggtgtgttcagtactccggaatagagcaggcgtgctacgaagagcgataagccgaagagaaggacatagaaggtgactttgagtgtagctacatttttcaatgacgtctggttgatgcccacaatgtatatggcataggaaagggaggaagcgaaaaccagcaatgtccctatcaggctcagcgtactgccgtcctcacttttatagagcagcccgatgcctcccagtgcaagcagcatgcagacgatggtttgcagtgccagcttctctttgaagaccatagccataataagagccaccataatggggtagatgaacagcagtgtcgacgctatgccggcggccatataattataactcagaaaaagcgtcagtgaggagagggctacgagtaatcccatgatgatgagcggaaatgtttctttccgttgtatcttgaatgtccgccctctcgcttttatcataatacccagcaatgggatggcaaaaaggtatctgaaaaagagtaccgagtccggatccatgccggctttgtacaacgggagggcaaacaatggattcataccgtaggaggctgcggcgatagaacccaaaatatatcctttagcttttgcattcatatctttatctgtagattagcgtgcaaaggtagatatttactttgatttcctctttcttttctgtatgaaaaccgtatgaattttacccttataccttcagtgtgtagtcaccggcttcttctgtcactgccttctgcaattcttcgagtgtcttttctccgtctgaaagctctacgatggccaccggagggttcagggttacggtggcatgtacaccctccatactatttaatgctttctctacgtgcatgcggcaatggttgcacatcataccttctaccttgaattcttttttcatgattgtttctgttgatggttcaacttttttgttttcttccctttcatgtatctttttccgttttagcagcaagctgttgctcaccacactgacactgctgaatgccatggctgcgccggctatcatcggattcaacaggaagccgttgatgggatagagtattccggctgcaatgggcacacctactatattgtatataaacgcccagaacagattctgccggatggtccggactgtcagacgggacagccggagggcttccggaatttttgtcaaatcggaggagatgatagtcattttggctacgtccatggcgatgtcactacctccgcccatagcgatactcaagtcggcttgggcaagggcggcgctgtcgttgatgccatcgcccaccatcgccactttccgtccttctgcttgtaaccggctgataaaggctgccttgtcctgcggcagtacgctcgcttgataatgcgcaatacctgctttgcgggcaatttcgcgggcggtggtttcattgtctccggtcagcatgtggacttcgataccggtggcacgcagctcgtcgacggcacgaatggaagtttcctttatccggtccgtgattccggctattgccagtgcgttttcttcgtcggcaaaccagatgacggtttgtgctttcgctgtcagtcgggtggcttcttcccgaagagaccggctgatggcaatccggttctcttccagtagtttcaggtttccggcaaagtaaatccggccttgtgtccgcccttttacaccttttccggtgatggtttcgaaatcttggatgtcgtctatggaagccgattccttgaggtgattcactacggcgtctgccaatggatgttccgataacttttccagactgtagaaaatgtccggcaagacatcttttgaggaaatgcttggattgggagtagttgtcggcgtattccataccagcttactgactaccggttttccttcggttacggttccggttttgtcgagtactacggtatttacctttttggcaatctccagactctcggcatcttttatcaggatacccctttcggctcccttgccgatgcctaccatgatggctgtaggagtggctagccccagcgcacacgggcaggcgatgataatcactgtgacaaatgccaataatccgtgggtgaatccgtcggttccgtccagcatcatccatacgatgaaggcgagcactgcaatgccgataatggtaggcacgaatatccctgctatcttgtcgaccagttgctgtaccggtgctttgctcccttgtgcgtcttgcaccatgtgtataatctttgccagcagtgtatctgtgccgactttctctgcccggaagcggaaactccccttctggttgatggtacctgcgaagactttggcatctttttgcttggacactgctaccggttcgccgctcagcatactttcgtctacgtacgaagaaccttccgtcacgatgccgtccactgcaatccgttcgccgggcttcaccagtatgatgtcgccggggcgaatctgctcaatagggacaatgcgttcctcattcccaacgacggtcacggtcttgggttggagtcccatcagcttcttgatggctgttgaagtgtttcctttcgccttttcttccagcaggcgccccagcaggataaaagctatgatgacacttgccgcttcaaaatacacatgcgggtggatgcccctggacagccagaagtccggaaataacatgttgaacagactgaacagataggctgttccggtgctgatggctaccagtgtatccatattggcgctgccatgtctcaactgtttccaggcactgctgaagaatccccgtcccagccaaaatacaataggagtggatagtgtccacatgataggattggcatagggcatatccatgaaaaacatacctattatgataacaggtaaggatagaataacggcccagacagtgcggagtttcagtgtagtgaattttttgttgtgggcctcttccgcttcttcgagcgtattgccgtcccgatttatcagcaagtcatatccagcggcctgcacggcttgctgcaatgcctcggaagaacagttcttgggatcatattctacggttgccgttgccgaagcgtagtttacggctgctatcttgacaccggactgccggttcagcgtcttttctatccgtgcggcacatgatgcacagctcattcccaatacgggaaatgtctcttgaacaatattcttgtctgtcataacaattatgtatttaagtttcgtaagttcttgaacttgcgaaacttgagttatgtataagtcatagcgatacaaagataatgctttttccccttgaaatgttcatcgcttaaaatcgcaataaataggctacttctcactggggaatgcttttttaatgactccccgactcaatcccgtctgcaccgctccccgcatcaggaggtaggtgaggaaggcaagccataaagcatggtttgccaggacgggatgtaggccataatacaagacaaagaagctgacggctgctgcagtcatggacagcagcatgccgcgcgtggctgtggcacctataaaaatgccgtcccaaatgaaggcggctataccaacggcaggaacggcaagcgcccagtagaaataggtgtcggcaaccgctatcacttctttgtcatccgtcaatagcccgaggaaggcattacctcccagtgcataggtcaacgtaaagagaactgccattaccgctccccatccaaagagatgtcggacggtgtctgtaaaggcttcccggttgtgtgcgcctatgtatctgccgctcagggcctcgcctgcgtaggcaaaaccatccattacatacgagaacaaagtgaagagctgcatcagcagcgtgttgacagccaaaatgatttcgccctgcgaggctcctgctgaagtaaagaacagagtaaccaccaccaggcaaagggtgcgcagaaaaatgtccctgttcacttggaagaattttagcattgtctccttctcccagataccttttctttcttcccctttaatttccaatttataatttttaatttcccagtatctctgcaactttccataattgcgtatccagagcatcagccctatcaggaaaccggcgtactgggctatcagcgtccccagggcaactccttcgactttcattccgcatagatagaccaggcagaggctggcaatgatattgactatattctgtgtgatggctatatacatgggaatgcgtgaattctgcatgccgatgaaccatcccgtgagcccgtatagtcccagcatggcgggtgcaccccagatgcagatgtggaaataaagcgttgccatctctttgacctcgtctgtaggatgaatcagcaggaatgcgccttgtctgatggggacttgcaatgctatgaggcaggacgcgacagccagccctatgccgacggagcgcactaataggcgtacaacttccggcaaatcccgttttccgtatgcttgtgaagtcattccgctggtccccatgcgcaggaaaccgaaaatccagtagatgatattgaacagcatcccgcctacggcaatggctccgatataggccggtgaacctaagtgtccgacaatggctacatcaatcagtccgagcaaaggaacggtgatgtttgatacgatggaaggcagtgctatttgcaagatttgcttgtctctgagcttcattggtaacgcttatttcataagattggcaaagttacgcagaaaaggggaaaatagtgggaaagattaactatattttgttgatgtttgcagtgaaagtgtgtaaatttgtaggtgaatttctatggagatgattcaggctgttaaactattatatactttaaaaatgaaatccttaactttatttttctctttgtttctgatgttgcctctgtctgttttcgctcagtcggcgggtgaactgttgcagaaagtttccgaagcgttgtccgaaggcaaggacgattatgtcgtaagtctgttccgtcagtcggcagatgccggtgtggaccaggcggaaatgttctattgggccaatgttgacaagaacactgtggtagcttcccgtttggccaatgagctggctgcccattacaaggaaatgcggaattacgacaaggcctatctcttctataaggagttcttgcaacgccatcccgaagatgtgcctgcccttgtttcttgtgccgagatggaaatgatgcggggaaaagagaaggatgctctgaaaacctacgagaaggtgctgatgctcgacggtgataacctgcaggcaaatatcttcttggggaattatttctatcttcaggcagaaaaggaaaggaagaagctcgatgatgactttaagaagataacttcccctacgcggatgcagtatgcccgttatcgtaacggtttgtcggacgtgcttaccaatagctatagcaaggcaaagacctatctgcaacgggtactccaggtattcccttccatggaggcgggcaatacgctggaaagaataaagaagatggaggcggagatgcgttaatagtagctcaatctcctttttgagatacggattgcgcaagtaatagatttctaacgcttattcatcgcgggtgcgaagcgaggtgtcgtgcgggaagacttgcttggcgaggcatagctgttcactcccatattcttccgagcagcgtcttctccgacaagatgatggatgcctttcctttcatgcctttctgcatgaaagggacttctttcagtgacagtataaaacagaaatagttgtgcccgttgcggctgattatccgtgtagatacggggcacagaacgaagcgtataaaacgatatattgaataaaacaacacatcgctttataatacaataggttacggggaaggatagaaggaacttccgcaaaacgaaacgtttacgcaggtttaatttctgtttacgtggagggctgtttgacagttgttgaattatcgtccgacagctgtcggacgataattcaacaactgtcggacgattaattcttagtaagcaaaaatataaaataaagcatataatacagataaatcattaactttgcctgcagaaaacagaaatagtttatggcaaaaaaaaacggaaacatcctgattgtcgatgataaccgaggcgtacttaccgccttgcagcttttgttgaagccatattttgaagggataatcacacttccctctcccgtaaccctgcccagcgtattgcgggaaaagtcatggcaagtggttcttcttgacatgaacttcacctcgggcatcaacaccggtaacgagggactatactggctccatgaaataaagaagctatgtcccaccctgcccgtagtgctgtttaccgcttatgccgacattgaccttgccgtacggggaatcaaggaaggagccacagacttcgtcgtgaaaccctggaacaatcagaaactggtggaaaccttactgaatgccgtatcagcttctgaaacaaaatctccggccaacggcccaaatgccagacgtacggcagaaaacaaccacccgcttgcggatatccgcaacatgtattggggaaacagctccgccatgcagcaacttcgcctcttggtggaaaaagtggcctctaccgatgccaatattcttattacgggcgagaacggcaccggtaaagagatgctggcacgcgaaatccactccctttcaccgcgcaaccggcaggacatggtaagtgtggatatgggtgcagtcaccgaaagccttttcgaaagcgaactgttcggccacgtgaaaggctctttcaccgatgcccatgccgaccgtgccggcaagttcgaagcagccagccacagcaccctctttctcgatgaaataggcaatctcccctaccatctgcaagccaaactgctgaccgccatccaacgccgcagcattgtccgtgtaggcagcaacactcccattcccgtagacatacggctgatttgcgctacaaaccgcaatctgcccgagatggtggcaaaaggcgaatttcgcgaggacctgctataccgcatcaacacgatacatcttgagataccctcgttgcgcgagcggcccgaagacatcatcccccttgcagaacttttcatcgcccgcttctgcaagcaatatgacaagccccccgtcaagctgacggacggcgcctgcgagaagcttacgctccacccctggtacggcaatatccgcgaactggaacatgccatcgaaaaagccattatcatctgtgacaacgaaacccttcctgcagaactgttccagctggcacggcgaaccggcactcccgaagcaaccgcatccacgctcgaagaaatggaaatgcagatgatacggaagacgctcgacaaatgcagcggaaatctctctgccgtcgccgcacagctgggtatcacccgccagacgttgtacaacaaaatgaagaagtatggcctttaattattcattccgcgttgccgtcagtctggcagtagcactccttgcaggggtgatgtggactgtagacgtattttggggcgcgttctgcactgcgctgcttcccatagccctgtactggcagcaaaggctataccgccatcatgtgcggaaggtgcttttcatgctcgacgccatcgaaaacaacgacaatgccatccacttctccgaaacggaaaacactgccgacgcacgcctcgtgaaccgtgcattgaaccgggttgcccatatactttataatgtgaaaagtgaaacagcccagcaagaaaagtactacgaactcattctggactgcgtgaataccggtatccttgtcctgaacgacaatggtgccgtatatcaaaaaaacagtgaagccctccgtttgctgggcctcaatgtctttacccacgtcagccagctgaaccgcgtagacccgcgtctttcgtcccttcttgccaattgccgcccgggagacaaattgcaaatgcctttcaacaacgaacgaggcactgtaaacatgtctgtccgcgtcagcgacattacagtccgtaaagagcatctgcgtatcctcgccctgaacgacatcaacaacgagctggatgaaaaggaaatagattcctggattaggcttacccgcgtactgacgcacgaaataatgaacgctgtcactcccataacctccctgagcgatacactgctgggactgaccgaagcgcaagtttccaaagaagaaatcagaaacggcctgcagactatcagcagtacgggcaagggcctgctctcttttgtggaatcataccggaaattcacccgtattcccacccccgaaccatccttgttctacgtaaaaagttttatcggacggatggtcgaactcgcccgtcaccagcaccccgatgttcgggtcacctttcatatggacatcgcgccaagcgaccttattctatatgccgatgagaacctggtatcacaagtagtcatcaacttactgaaaaatgccatacaagccatcgaatcggataaaaatacagataaagaaggacatatcaacatacgtgcctactgcaatgaggcggaagccatactgatagaaatttccaacaacggacctgccattcccaatgacattgccgaacacatatttatccccttctttacgaccaaagagggtggaagcggtattggattgagtatttcccggcaaataatgaggctttccggtggaaatttatccttattgcccagtaaagaaaccacctttattttaaagttcaattgaactattttagatttgtatttgttaaacacaatgcatatctttgtactattagacataagaaacatcacatttcaaactatatagcatagaatttatgatatttacagcaggaaacatactacttataggttctgtattactttttgtcagcatcattgtcggcaagaccggctaccgtttcggagtgcctgcgttattgctttttcttgtcgtcggcatgctgttcggcagtgacggattgggattgcagttccacaacgccaaggaagcacagttcatcggcatggttgcactcagcatcattctgttctccggtggcatggacaccaagtttacggagataaagcccatattgactcccggcattgttttgtcaactgcaggagtgctgctcacggccctctttaccggattatttatctggtggctgtccggcatgagctggaccaacatccacctgccgttgataacctcccttttgcttgcatccaccatgtcatctaccgactcagcctctgtattcgccattctgcgttcacaaaaaatgaacctgaagcataatctgcgccccatgctggaactggaaagcggtagtaacgacccgatggcatatatgctgacaatcgtgctgattcaattcatccagtcctccggaatgggagttccccagatattaggctcttttgccatacagttcattgtcggtgccgcaaccggttatttcctcggaaagctggctatccttatgctgaaccggctgaatatagacaaccaggcactctatcctatcctgttactgtcctttgtattcttcactttctccatcaccgacctgctgaaaggcaacggttacctggccgtgtatatcgccggaatgatggtaggcaataacaaaatcatgcaccggaaagagatttatacttttatggatggactgacctggcttttccaaatcatcatgttcctctgcctcggtctgctcgtcaacccccatgagatgctggaagtggcagtcgtggcattgctcatcggcgtcttcatgattgttgtgggacgtcctctcagcgtttttctctgcctgctgccttttggcaagagaatcaccctcaagtcacggctattcgtatcgtgggtaggattacgtggcgcagtacccattatctttgccacctatcccgtggtggctaatgtgcccggtgcccatgtcatcttcaacatcgtatttttcataaccatcgtctcactgatcatccagggtaccacagtctcctgggtagcccggctgctgggcctctccaccccgctggaaaagaccggaaatgatttcggagttgagctgcccgaagagattgactccaacctgcacgacatgaccattacacaagaaatgctggagcaggcagacaccctgaaagacatgaacctgcccaaaggcacactggtgatgattgtaaaacgtggcgatgagtacctcattccgaacggaacattaaaacttcatgccggtgacaagctgcttcttatttcggaaaatagcaaggaataagaattacagataagtttctatccgtttcagggcaagaaaaaagtggaaactatttgctttgcatcactataagacctatctttgcgcagttttaactaaagtgtgcaacagctgaatggaacaagaacaagggttcatcgattatatagaacaaagcattattaaaaactgggatcgcaacgccctgacagactacaaaggaattacactgcaatacaaagatgtagcacggaaaatagccaaattccatatcgtattggaaaacgccggcattaggcccggcgacaagattgccgtttgcggacgtaacagtgcacattgggcagtcgcttttctggcgacagttacctatggagctgtcatcgttcccattctgcatgagttcaaggccgacaatatccacaacatcgtcaaccattccgaagccaagctgctgtttgtcggcgaccgggcatgggaaaacctcaatgaagaggcaatgcccctgctgatgggtatcgtactgctgacggacttcactccggtagtttgccgcaacgagcagctgatggaggctttcgaacatcgcaacgtcctctatggcacacgtttccccaagaatttccgccccgagcatatcagctaccgcaaggaggaatcacccgaagaactggctgtcataaactatacttcgggcaccacgggatattccaaaggggtcatgctcccctatcgcagcctttggtccaatgttgcatattgccatgagatgctccccgtacgtccgggcgaccatattgtatccatgctgcctctgggacatgtatttggtatggtgtacgattttctatacggtttttccgcaggcgcccatctgtatttccttacccgtatgccgtctcccaagattattgcacagtcattctccgaaatcaggccacgggtcatttcgtgtgtaccgctcatcgtagaaaagattatcaagaaggatatcctgccccggatagacaataaaataggcaagctgctattgcggatgcccattgtcaacgataaaatcaaggctgacatgcgcaaaaaggcaatggaagtattcggcagtaatttcgatgaaataatcatcggaggggcaccgttcaatgccgaagtggaacgcttcctgaagcagataggcttcccctataccattgcatacggaatgacggaatgcggccccatcatttgttccagccgctgggaaacattgaaactggcctcttgtggcaaggcaaccacccgcatggaagtaaagatagactctcccgaccctcagaacgtggcaggagaaataatctgtaaaggtgccaatctgatgctgggctattacaaaaatgccgaagcgacttcccaaatcatcgatgtaaacggctggctgcacaccggcgaccttgcaacgatggatgccgaaggatatgtcactgtccgcggacgtagcaagaacatgttgctcacagccagcggccagaacatctatcccgaagagattgaaagcaaactgaacaacatgccctatgtgtccgaatcactgatcgtattgcagaacgacaagctcgtggctcttatctatccggactttgacgatgcattcgcccacggtatggaacaatcggacatcgaaaaggttatggagaacaatcggaatgaattgaatctgcaattaccggcctacagccagattacaaaagtcaagatacacttcgaggagttcgagaaaacggcaaagaagagcattaaaagatttatgtatcaggaagcaaaagggtaaggggaatgtatcaaaaccttctttaacgctttattttaggtgcggataacgcagattttacggattcagtttattgaatctgcgttattccgcgtaatccgcgcctaatattataacattataaaagtcttcatgtgcttttgacacattcgcatcctttttgttaacaaaaatagaagcaaaggaataaacagctaataagtgttataaaacatacttttttagttggataatttgcagatttatcagaagtccgtatctttgaaatgtgtttttcatagtattagatttaaggttaacaaaggttggagtacagcggtactcctttttttatgcccgtaaatcagatattcccggaaagcctcttcagtcccttcaatacagatttatctttcacctccatgatgctgatggcatagccaccaccggaggcagctttcagtttcaagaccgttttgggagaaacgatacctttacggataacataagcttgcggatttgttttataatcggcatcttttgcatcggcatagacggttgcaatatactgcttgtctgcatccaggaagtccagtttcagagttgaagcatgtccgtgctcactgctggtgcaaccgataaaccagtcattcgtaccttttgccttacgggcaacagtgatgtaacgtcccggctcagcttccagatagcggctgtcgtcccaatccacagccacatctttgatgaactggaaagcgtccatgaaacgctcataattctcaggaaggtcggcagccatttgtagagggctgtacatagtgacataaagtgccagctgacgcgtcaaggtagtattggcatgcgtatggctgttcggattcaacttattgatgtccatttcaaagataccgggcgtatagtccatcggaccaccctgcaaacgggtaaacggaagtaccgttgtgtggaagggcttgttaccggcaaaagcctcgtactccgtgcctcgggcagattcattgcctatcagattgggataggtacggcataaaccggttggacgtaccgcttcatgggcattgaccattatcttgtgtttggcagcttcggtcacggcgtataggtaatggttgttcatccattgtccatagtgatgctcgccacggggaatcatattgcctacgtagccactctttaccgaattatatccatatttattcatcagacggtaggcagcttccatgtgccgctcatagttacggatggaagccgatgtttcatggtgcatcatcagacggacgcccttggaatgggcatattcattcagatacttgatgtcaaaatcgggataaggagtcacgaaatcgaaaacataatccttggaattaccgaaccagtcttcccaacccgtattccaaccctccaccaatacctggtcaaaaccgtgttcggcagcaaagtctatgtacttcttcacattagccgtgttggccggatgaatgccgttcggtttcaccttggaatagtccgtatcatccagtttcacagaagggaggtcaaaagtatatgcccagggctttccccctgcaatcatttcccaccatacgccgacatatttcaccggcttaatccaggaggcatcatcatacttgcaaggctcattcagattgagaatcaaattggaggccagtatctcacgggcatcatcactgaccatgaccgtacgccagggagtatggcagggagactgcatataccctttatttccttgggcatccggagtcagccaggattcaaaaacgaggttcttgtcatccaggttgagatgcatgcaagagtagtctaccaaggctgcctcgtgcaggttaaggtacactccatcagctgttttaagctgtatggaagtctggacacccgtcggcgaaaagacagtttgtgacgcattgtcactcacagctccctgcagcagtccacggatttcagagagtttggactccgtgtaatcatattcctgggtatcataatctcccggaatccaccaggcagtatggtcgccggtcatggcaaaccgggaatgctcttcctttatcacaaaataaaccagattcttctgttgcggaaactcataacggaatcccacgccgtcatcatatacccgaaaacggatattcataaaacgagtggtagacggttgttcaagttctaccagcaattcgttgtagtggttgcggatatcttttgtttccccccacaccggttgccaggtttcatcgaaagtggaagtagaagtccttactactttgaaaccatccatcaggctggtagctcctttcagttccaatcccaacgtactgggattgatgacaggagcccctttataatccacctgataggctggtctcccgtcttttgtcagttcaaaatccagcttcaccatgcccgaaggggatgaaatgccttcagcattccccgccagggcagaaaaaagcaaagccgcgctaagtacaaatttcttcataataatgatatgttttttgtgttaatagataaactcaatgatatgttcctttccatcatccggcaacctcagcaggcaagtccccagcttcttgtcaggacaccaggtagttatcgtaaactctgtctcccgattttcttccagctttccgacattcgttttcttgattttctgaccgtccagcaaagctgttctcggcatctgttccgtatagatgcagaacatcaggtttcgttggccgggtaagctatatttctcaccagtccgtgtacctactttcagcgtatagcctttgtcggtagtctggcaagtaataggagtgcgcatgaactctccacgcaaatatcctaaatcagttcctgcatcttcataaagcgagaaggtagtttcactgcccgctgcagcaggaaatatctcaaacgtaaccggatagaccggtttctcatccgtatagttcatgaccggcatttgaggcatgatacttccctgctttacaaacataggaatagtattgaggggagcatccaccgtcatccattgctcaccgctatatgctgtgtgtttgttgttgtagtcaatccaagttccttcaggaagatacacattcttgtttcgcgctcctttctttaccaccggagcaaccagcagttcgctgccaaacatgaactgggcatccgttgagaacgtttccatatctgccggatattccagaaacatcggtcgcatgagaggcaaccccgtttcgtgtgcttcgcgggcatacgtatagatataaggcaaaagacgatacttcaattcgatggctgccttggcattcttctcggcctcttcgccgaacagccacggctccacagccacgttgccctcatgatgaatgcggctcaggggattgaaagcgcccatctgtatccaccgcgtataaagttcagccatcgcaggataattctctatatctccgcaataaccggtaatgtcacaagtagtaaaaggaataattcccaaaccggcagacaacagtaccggaatctgattggccatctgtccccagccctgcgtcacgtcatcaccgtttccacagtcaccggtccagccgaaggtatagcgttgcaagcccgcaaaagcggcacgtgtcatctgaaatacgcgacggttaggattccgtttctcaaactgctccttcaccaccttatcccacgtaagaccataaacattgtgaatctcatcatgcatgcccaaatggtgtttcatcaccaggcgttccgtctgctcctcattgctccaggcaggttcacccatatcagtccagaaaccggcaatgccatcatcaatgggcttctgctgataagctccccaccagtctgccacagcaggaagggtgaagtccactactccacaattaccaccccagggccagggcatgccataactcctgccgttggtggagtcctttaccagataccctaacctatcggcttcctcccattgccgcttattggcttgtgaaatgaccggatcttgcgaaaccaccaccttgaagcccatatccttgaggtctgcaagcatctttttcggattctcgtagttccctttccgccactcaaaatcctgcaaatactgtgtccagcctatgtcctggtaaataacatcacaaggaattccacgcttacgatagccttcagctatttcataagacaatttctcgctcgtcagcagtccccggcattgtgcaaagcccaatgcccatttaggaggcattatgggttttcccgtcaggtcgacatattgtttcatgatttccttataatccttcccgaagatgaaataataaatcatctctcccccaggagcctcgaaactgtagtaatcgcggctttccgtaccaaacttaaattcggtcttatacgtattgtccaggaaaataccataacgataactgctcataaagaacggaatactcttgtagagcgggtcctcaacggtactataacaaggcttgtcactgttccacatcttgtaggcttcgccgcgacggtccagcttgccggtcttttctcccaagccgaagaagtgttcgtcacgacggagggtcttgtattccaatttgcgctgcccgttactgatatgccccttatcggcataatcactgaacagcagtttctgatacttgtcgaatatctgtaagttaaacggagacttgtttacccggatacggagtttaggggtaaaaatctcgtagcaggcattctgttcgtccacatggacggtaccgacatcctccaggtcctcattgacgacggcaaaggaaggattattccgctggaaactaccgtcgggagaaaaccatatacgtaccgtagactgactacacagacgtaattgtatggcagaactgtcatttaaatagaaggtcacactccggtcgtcactggtataggaagtgcagtctccggtgcggttctgtgcattcgcatatactgaaaatgcacagacggcaaaaaataaaaatatatatttcttcattactataatttgtttgttcctttattggatattcttattccatcacaagcatgctccagtacttcagcaagggcaaggtaaaggtaaccgtgccgtccttctgttcgaatgccagttcctgcgaagcaccggcatggaaatcgggcgatgcaacccatatcttgttcactttaccggaaacattcatcttcaacggcacgtcggacaccagacgcggttcgggcattgttccgttcagatccctccagcttaagttatccgcattgaggaagttgagcagatgaatgacttgcctgccatttacattcttggcatatacagtgatggcagacttctgcggcggccatgcattcagagaaagattccgcgcagcatccgtacagttcagagaaacggaaatctccgcctccgtatctttatcacgaagcaggttctgataagccgtcataaagtcataataacgaatcatggctattttcagtacatcgttcatctgcaaagccgtgcttggaaagtactcgcggcatagcatgtggtcacccaattccaaatgagagcctcccaaagcaaatatcacagcatccgtcagcagcacacccggtgtattgaactcaccggtactgctacctgccttgtcatagttcatatatgcggcaaacaccgttttcaaggcatggttgccatactggtcgttcgctttgataatggtgtgcagatccttgaagcctgcctcatcgccccatacttcattataaaggaaatccactttacccgtaccagctatctgggaagctccatagctggagacggcattcatcaccaaacgcttgtccggatgcttctgtttcatggcttcgatgaacgaggcatatcccttaggcagatttaccttattgccatcatagtcatagcggtcaccccggtttcccagttggtctatctgataaccgtcaaagtccagattggcataaacatcatcgtttctctgggcaatatatgcctgccattccgtattggcgggattgagcaggaagatattacttttccaactggagggcaagtcatgcgaatccttatccatgcgtcccgtgttcttgaatatgtaccattcttcctttaccccgtcggaaacggcatcgtccaaagctccgaaacatagattgtagaacatggacttcatgcccaggctgtgttgtgtagagatatacttcttcactacctcggtatagacctcccggttggcaatgtccttatagacctcgtccagatgctcacgcgtaccgcccaacggccaatgatgcttgttgtgccaatcctgaaactgtaccccgttaatgtggcaacggttcaggaaagccatctccttctctatcactccatccacctttttcgaagcatcaaaagtggcaacgaaaccataacgtggaaaacgtgtccagtcactggatacatctacggcaatagtaccaagaataacctctgttccattctcttttgtacggtatacatccaccagataaccggtataatcggttgccggagcagtccaagtccaagtagtaccgacagcagcctgctccgatacaaccttgtccattgtccggtagcggattttagctccggcaggaagggcgtcagctgtaaaagaaacactctcgcccggccggtaacatgccttgtcgatagtgagattgaccgtcaagtccgaggtgactggggttacttccgtaacccctccactctctccgcctccaccggtaccgctaccggtatcatcactctccttgctgcatgcaaccagcagcaaggctaccattgttgtataaactatcttcttcatctattgtagatacctattgtttcacgattgaaattgtctcttccagctgattcaaagtaatcagataggaacctgctgtcgtaatcttccacttctggtcgatgccgcctaccatcacgtccagatattgcgctttgaacgcttcgtctgatttatcaaggaaaagcatcggttctgtttctcctgcaggctgtttgtctgctacagccggcatgaaccaggctccattccaatcttcctgcttatcacaagtaaatttcaactcaccggcattcagcgtacctttccaagtaaacacatacggattatccgttgtctgcatcggcgtagcatcaccaatcgtccaaccggccggagtagcatcacctaccatataaatcatctcatacggagtaaattcgctcatcatcatgcgttccttaccactacggatatccatgcaaatcttgtaggccttgccgcattccccgtctttcagcacccatttattgtccgggtcgaaccctttcacaaacaccacttctgtatcggtataagcagcatcggcattcttggccttatacatgttctcccaacttccatcggaggttccgaacttgaattcccctcctttgcccacttcaaagaacttgccgaagcggaacaagtatgggtcgagcacatcttgtttcatcttcacgaatccccaatccgtagcgttacccacaaaataaagctggtcgtaggcaggtgccaacgtctctgtctgggtcaatgtaagaacaccggtaaacagattggcctcgacgatgtaattatggtcttcttcgacaacaaaaggttcatccggctggtcatcactgctacgaagaaccagcaatccatctgttcctttgttgtaagagggcaggaatgagcctaaggtcgtgatgaacttaaattcaccggccacaagccgacccgtccatgtaaagataccattgtccttgcgggtcatctctgtcgcatcatcggcactccagccgcccggagtggcactacctatcagataaagggtggatgtgagcggtttataggctgtaacactgaaagcagtggtagacacctgtttttcgtcccgttccgttacagtagctgtcaagcgcgcttccaacgaaatgttctccccggcagttgccccaaaatggttgcgcaggatgtcattcaattcctctacgctctttttccatgagtattcttgtacggcattctccacagctacataagaatctgcaaaatcactgccggtcttggccaattccagcgtataggaaattttattacccgtcccataattggttcccgtagtccaggaaagctccagggcatcatcggcatgtgcctgctcattcaaaacaacttccgtcttgctggccgtcagtacaagttcattctgtcctttatccaattccatgtaatcatcatctacacaagcagataaggctgcacagcccagtaaggcaaatacaaggtgtgaaatatatttcttcatattcttctgattaaattaattaataacccgggttctgcaccattaaggtattagcatccatctccgtctgcggaatagggaacagcaagcggttcttgttcacgttgctctttccaatggactgcaggaatttaatggcatactctccattgttgacacgaatcatgtcgaaccagcgatgcccttcgaaagctagttccatgcggcgctcatggataatcttttcacgcatggtttcctgtgacaagcccgaaacctccggcagtccggcacgcttacgtacaatattcaaaggcacggcagcctggtcagagcgtcccatttcattcaaagcttcggccttcttcagcaggacgtccgcataacgataaatcacgaagttggcaggattggtattgtattccggagaaaccgttttcgacaccaggaacttgcgtacattgtatcccgtattggaataagagcttttgtaagccttaccgtcaaaatccggacatccggcataaagcacggtcaaatccttacgtttgtcaccgctctcatattgacccacaaattcttctgtaggctggttccagccataactgccggcaacaaagtccgaattacggggacccatgaaagtagaaagccaggaagactgcggattgtttccccaaaaatcatattccgtattgcccgaatactggacctcgaacaaagattccggcccgttattgaccaatgcatcgaaattgtcctcatacttgcaggaagaaaggtcataccccaaatttgttatctcatcacacaaatcagacacctcttgataatattccgtatgattaggagccagcgtcagataaatatctgccaacatggccaaagctgcatctttgcaggcacgtcccacgttctcgtcgtcgtaagaagacttggcaggaagcaggtcaaccgcattcttacaatcggaaattatctgggcataagtctcttcgactgtagcgcgtgcaatgtctgtcggttctcccggattataaggagccaaacgcagtggaacaccaccgtacagacgtaccaatacatagtaataatgtgcacggagaaaataagcctctcccagacagcggttcttgattctctctgacacggcttcagcctccagaagactattcaacacaatgttgcattgtcctatccccacccagggagaacgccacatgtacaatgccatgccattgtcgctctgcgttatgaagttagaagcttgtatcgtttcaaggccgtcggtaccgccaccggcacccaccagactgttacccgccacaatatccagtgtccagatacgctggttgtacatattggaagactgaagggtgcgatagcaggcattggtcagagcaatggccacatcatcggtcaccgtcgtttccgggtcaaccgtatttttaggagacttgtccagaaagtcgctgcaggaagccagcagcaatactgccagcatatatagtaaatttgttatctttttcatatccgagtcaatcattaaaagttaaagtttaatcctaagctgaacgtacgggaaatggggtaacggttctggtctattccgttaatacccacttcggggtcgaaaccggaatatccggtgatggtagccacattctcacaagatagggaaaggcgtgcattctcaatctgggctttctgtaaccactgctttgggaaagtgtatgaaagtgtgatattcttcaaacgcagataagaaccattctccacaaagcggtccgacacgcgtgtattctgattggggtcgccgaacacggcacgcggcatcgaattgctggtcccctctccttgccaacgcttcagtacgtcggtagtctggttataggcggctgccataccggtattgtcgatattgttggcattgtatatcttatttccggctataccttgtaagaaaacagaaagttcgaaacccttataggaaaggctattgttcatagagaacagccaacttgggttcgggttaccgatgacggtacggtcactatcattgatgacaccatcgttgttcaaatccctgaaacggatatcacccggctcagctcccggctgcacggcatgtgtattcacttcagactggttctggaagattccgtccgtaacatagccgtagaagacattaatgggatagtcctttgccagcatcgttacataggagttattgatttggttaatgtaataaggaacgtcgctgttcaaatccttaattttattcttgttgtaagtggcggtcacgttcgtttcccatcccagttcaccggtaagattgatggtatgcagactcatttcaataccttgattacgtacttttccggcattggtatacgtggttgtagtatcttcaaatcccgatgtgatggggatagacgcctttaccagcatgtctctcgtctccttcagataagcatcgaacgagaacataacgcgtgaattgaacagtgaggcatcaaaaccgatgttggtttgtgccacctcttcccaatggatatacgggttggcgagagtagaagaaaccagcgctgtctgattgccgctcgaaatgccgaaaggatatacactggtattgtaggatgccagatagctgtagtttccaacacttgcctggctaccggtcacaccgtatcccgcacgcactttcaggtcattgatatagtcgttttttggaaaccacttttcctgagaggcacgccatgccacagatacggaagggaaagtaccccagcgatgtttcttaccgaaacggctggaaccgtcacgacgaatggttgcagtcagcaaatagcggtcttcgtaagagtagttgacacgtgccatgtaagagagcaatgcccactctgtctcgtttccaccgatggcatacatttcctcgccattatccatttcgtgcacattgtcgaacataaacacattcttctgcgcattcaggtagtcgttggtgttccattgggcagacataccggccatcaatcccacacgatgtttttctgcaaaagtatggtcgaataggaaatagttgtcccacaaataagtgaacgacttgttatcgctcttataacgtgaagtctcctctgtgggagtgggtttccagttatacttgggggtaaagttgtctatgaaccagaatttggcatcatagccgaaagtacttttaaacttaagccatttggtaaaagtaagttctgccgtcaagttggccaggaagttatatccatcagtctgactcttgttcagttccgtcggtccaatggggttgcgcgtgctgccataccattccgagttaccatcagggccactccaactgccatcttcattcttcaccggataaatggggagcgctttcagcgcatcacctatattatagctgcccgacttcttcgtatcggcactgaacgtaatgttattggagaacttcaaccatttcaagacttgcgcatcactgttggactggaatgtgaagcgacggtaattcacactcttcacgataccggactgatccagaaaaccaccggacacataataatgggatttctcgttaccgccggaataacttaccgtatagttctgcatcacacccgtacggagcaattcatccatccagtcggtacctgcacccaattcagaaggattggcccattccggattaggattgcgtccactgttcaccatcatgtcattactcaactcggcatactgcgccgcgttcaataaagaaggtacgttcgtagcattctggaaagagtaattggcagatacagcaagttttccttttccttccgtaccgcgtttggtggtaatcatcacaactccattagctccccgggaaccgtagatggctgtggccgaagcatccttcaatacatccaaacgttccacatcggccatatttaaggaagacaagcccaagtcggtaggcactccgtcaatcacgaccagcgggtcgcagttgttgatagaacccaaaccacgaatcttgatggatacattgtctcccggtttaccggcatctacaatctgcacacctgagatttttccctggatggcttgtcccaaattggatacgggggaatccttgatatccttgttaccgatggaggacactgctcctgtaaggtcgcttttcttcatggtgccataccctatcaccaccacttcatccagcatttcggcatcttcagacaaaactacctgaagctgtttctgtcccttcacctgcacctcttgagtcttatagcctacaaatgaaacgacaagagtaccgttcgaagacatgttcaaagagaaatcaccgtcaataccggttattgtcccatttgtggttcctttttccattacactggcgccaataaccgtttcaccggtctggtctttcactacaccttgtactgtaatttgctgtgcgaacatgcacatcggaagtaacattcctatcagacaaaccatcatccgtagcctgctgattggcattttgtacttttgcataatataagaatttaaagttaataataaaaacataaatcacatgtgtcactctttccgaagaggaacaatgcaaatgtatcagataagagaagccaatagtggaggaaagagtaaaaaagtagtggtttacatcattcaaaaaggcttaaaccgctatataccaataatatataaaatcattacccaactaaaaaagtagtgaaaatataagcgtaaaaagagacacttccaagcttcaaaacccctattctcagttcttcgacttgccaattgtcatcacttcctgttccaacaagtcgcggtcaccggcagccttgttgcgaaccttcgtacgatagttataaatggtggtaacagaataccgaaggaactgggctatcttcacgctgtcagtaatgcccaaacgtatcaatgcaaagatgcgcaactctgtattcatccgttcgccggctttcaaggatatttgctcatcatcggcaagcagggcattgaagtcttctacaaaagtaggaaacagctgcaggaaggtattatcaaagttggtatagaattcctttaattccccctctatgaatttagaagacttgatgttcttgtagagttcctccacatttccggtagcggcaatctttcccagcgaccggcggtaattgtccatcttttccaaatagaccgagcactggtccatataacggccgatatactcctccttcagataggagttttcggcaatgctgtggttggcctccttgagttgtgcattggaaaggtgaagctcatcattcagctccttcaaccgtttgttggcgtcaatcacttccctgcgggcagcagccactttcttcatctgcttgtatacataaaatatggcaagcaacagaaaaagtgaaagcaggctgatagataccagtgcccatttcatctgctcctgctgcttctccgtcttttgctggtaagcatcattaatgatgggaaagatttccagaatctccagcttgcgcaaccgggcattgcaggcggctgcatcttccatacatatctttacataagaataggcacgctcgatgtctccttcctggtaaagcagtacggcgagcttgcgtaaagagatatattcacggacagcggttttcatatccgccatagcagaaacaatcaagtattccttttccttctctttgtcccctttcagccggtaagactctgataaagtataggcacaaatcgcaacgtcgtgttcatagtccttctgcagcgccagataatccgtcagcaaacggatggccttgtcatattcattgcgtacattatactggtcggactgaatcaaggtatgtatcagaagattatctttattgaccaacagcaacgaatcacgatatttgtccgtaagctccgtataaagcttcttttcatatgccgtcacggcataatcggccataaggccatagaccgtacggtagatatggtaataatatggatggatatccaccgacaaccggtctatatggatattccgcatcaaatccataacttccttatacataccggtcattcccaaaacatctgctttattcatgcgggcattgtctatgtattcccggtttccaagacgtatggctatctgttccctttcctcggccatgtgcaatgcagaatccgtattgaacgaacggtactcatccagcaatgtgccaagaatggcaaaacgttcttcatccggtatctgccgatgcaactgtcttttcaattccgccagtttcagctccttctgctccatatatatgggacgctcctttatcgcctggtccagtttcagcagcaaagaatccgcccggctgctgtctgcagcatgaaggcggcacatacagatggtgcaaagacacaagaatatgattatatttttcatccggctttccgattagttaaaggcaatactttttgagaatcctcatgcaaaagtaattaaaataccataaaaacctattctactatcattaaaagctcgaaagcagagtgataaaaaggcatactgcaagcaaaagaatcaaaatattgaattacctttacggaaaatccaaagaaagaccatatcataaatatcatccgagcatcatggatatacacacatttattgccaattatcaagaagctttcggccaacatgccgaactccccatcgccttttggtattcagaccgaatggaggcatctacagagaaagtaaccggttgtctcttcaaatgcatgaaacaagtcggagacggcaaaaccgtcagtctcagcaatgaaacaatcacttgcggaggaggcaagttctataccggatttacagaaatgcccgagcgcgtcccgggttttgtctccttgaaagagaaatacaagaagactcccgaaatggtggtagattttgtcaatgagctacagattcccaaagcggacaaagcctatctgcattttgcccgcatagacaagataccttcctttgacgaggtggaaggcgtgctgttcctgccaactcccgacattctatccggactggtgacatggaccttcttcgacaacaatgcattggatgccgtggcagccccattcggctccggctgttgctccgtcattacccaaaccatcattgaaaaccggaaacaagggaaacgcactttcctgggattcttcgacccctccgtccgcccatacttcgaagcggacttattgagcttcactatccccatgtcccggttcaaggagatgtatcacaccatgcgtgaaagctgtctgttcgatacacatgcctggggaaaaatcaaggaaaggatacagctttcccaatcaagagacgtacatatcctcccctctcccatctccttccccatccttccggacatttatctgcaggaaatcagaatggaagatgccgcagccatctactatgccatcgacacacaccgagattacttaagaacatggctgccatttgtggataatatgcgcacaacagctgatgaagaagcttttttacgtcaggtactatctgctcctgccgaacgaaatgaacctatattcggtatttggaaccagcagcatgaaatctgcggactgataggtttccatttctccgatttcgacaaccaccgtacagaactcggctattggctactgccggaataccagcaccggggcatcattactgaaagtgtccgcaagctgtgtctgtgggccgtacaagaaaaagagataaagcggatacaaattcgctgtgccgtgggcaatgcagccagcaacgcgataccggttcgcctcggtttcatccatgaaggaacagaacgttgcggagaactgctggcttctggagaatatacagatatacatatatacagcatcttgaaagaagaagtgctggccaacctcaaacaataaaatatcaaatatatatcaactattgaaattatacatggaacaacaacctcatctcaatgaccacaacaagcaggagtaccctcctatgcatacagcagaaatgaacacatccttaattaatcaactataatacagagcattaaatcatatactaaaaaatcataattgcgcatttatcttacgcaaatcaatttacgcactcttttacgcacctaaatttgcgcaaagacaataaaaagagtaaccccgaaaaacgagattactccctcaaaaaagataatgaatagagaagtatcgccatacttctctagtacttaaagaatcatatacaactttgagtaagtcaatcttacccattgtcatatatcaataaatatctcattcattttcatatcacgcatatatctttccgaataagacatcggtgaaggattgagataataacccttacatacgtgaggcaaaccattttcttttaagcaaacttcaaagaaagcatcaatcaaagaaattacggaagtacatgaagatactttgcaaatagacaccttctgttggtatttaaccgatatttctgatacaaaactttttaaaatagtaaaatcgcactgttctttacgcttattaaaattgacgacagcaaaggtaagcaaatagccctcatttatgcagtaatcgaatattggaatataacggaaatcttttttcataatatccgtttgtagttcttttattactcctttctctacgcaatcaacatcattaactcctattagcacaaatccatgttgtaaatatcgccacatttttttcgccaccacttcatcaaatggaattagaggattattattagtagtagaaatattgaatattttttgtataaagttcataattaacgtattagcaattaatatacatattcaatcaagtaatatcctttggagtaagaactattctttttattgattttcttcaatagattaccttcataaatgtaatcgaaagtatcatctttcatatcctgatatgaaataagattatttggcttattgccacaccattcagttgcaaacagtatatgttcattataaggggaattataatgctttatcaatgatgataaattaatgttggtattattggctttattaccataatgaatatcaaaagtctgtgtaatattatcgtcattggtataatggtacttaatcatattgccattttcccaagtatattcctcgtagttatggattttataccgattaccgcctttctcctcaaataaatcatcaatgctttttaaatctccattatcgtaatatattaatgtaaaaagagttcctgcttctacaccttttgtagaataatcatatagtttgtctatatatccttgttcattaaaagtaaattcacatttggtataggggtcttgtttgccattcacataagaaatgaattgataccgattattggaaagggtaaaaatttcaactgtcttgttcttgaaattctgataatactctttccgtacttcaatcaggtttccatcatcgttatacttgaaatgataccacttatcccctttgttgccaacctctttttgagtaaaagcattaacccaatgtatgcttttcaccatatactcacctttgttattcgttttttgagcgaatacgcatacactgacacttgttaaaatgattgttactaaaatatttttcatacttctgtatttttaagtgctcgttaatgactatcgtttattatttcatttgaaatctgtttcaaattgacaaacagtgaattatcaccaaccttcccatatccttttaaatgttcgggagaagaaaaagaaagttcaaagacaattttctcattttggctttcaccaaccaactgcaatttatcggatattaattgccctgtcaaatctaacaccgtaccatactttacattttggtattcaccatttatcatgccatttgacaaaactccaaaatccacctttatgggaaaacctttcatatcaccctcataacggtaaaaatatccttctattaatcctgcattttcgcttcttcgctctatttggggattttcttcatcaacaagccttttagttccacccaaatccaccaatttatcaccgtcatatttgaaaatatggctgtcttttatggcagttctttttccgtcattcattctcttcatatattcaatgcgataggcatgtatttctccattgtttatatttgtaacaaagaacatagtatataattttgttgcaacagcaagtttgtaagatttaccattattcagaaaacaaaatatataggacttgtcttcataatcattgtcggatatttctttcgcactcggagtaacatacgcattaactaccgcatcatctataccgtcaccatccaaatccccaataaagatattatacccttcactgcacttttctaacggaataagctctctatcacctttgtagtgtttccaatgtcgcagaaatgcttcttttatatccgtttctgtcagtttttttttcgtttctgtgttcttaatggggatttcccgtttaaacgtatcacgttgttcgttattggtctgttgtatgcccgtgacgttttttttattttcattctgacgattaccaaccttatatccaacatacacaataaaaaggatagtaagaaccgcagcaacaccccaatatactcttttgccactttttaagattgaaacattggatgtttgctcgcatttctctgtttcattcttggatgaagtatttgtcgtctgtacattctcgttagtcggtgtgccacacatgggacacgcttccgacatggcagacatttggcaaccacactttttacatgtaatgtattccacttcctatttaattttaattgagaccttgttagtaattaacagaatgatactttgtactgcaagagacaatactataaccaatagaaaccaattgttttcaaaagttttggaagaaaacaacgataatacaaactctatagctcccaatatggaaaacagtacatgcaacgatattttaaaaccatcttttagtgctatcacattcaaacaaaataatagcgcagtagtagcgactataaccaaactactgacaaacaagttgaacacttcataagatgaaagtatcaagccaaacagtagattggcaactaaaaggattattcctattactattataatctgtttcatagccgataaaattacatggttggtaacttgggaggtaattcattgaagaaagatgaaaattcaggaagttgggatataaatccccaattagccatcccctttttccaaattaaagtatttccctgaattgtcccgttttcaatattcactttaatagtattgaagtcaaaagccccttgttgctgcccattgaccgcaatataatattcttggacgggcaatgggggaggcactgttaatgatgggggattaacatttaatgtgttcatcgccatactaccgacttgattacctatatttagtcccattccaattccaacgcctgagctgacaagcccacctccttcattggaagccgcattctccaaaacattgaaactacgctccatttggtacacatcctttcccgttatttttaaacgtgctgccaagtctttagcttctttcaaacggataaaacttgggtcgttctcttgaacattaattcctattacattgaaattttcaagtttaagtccgtacttctcaaattcaacgccaatgcgttgttggcaaaattcggatatgtcacttatgtgtgaatttatattaatcaccgatattccatcttgggacaatttttcagaaacaatatttgtcagtttagacattataatccccctaaaataattggtaagtttctctacagtgaacgaagtcatattgcttaccaaactttccaagaattgtcgtgggctaataattttaaacccatactgtccaaatgcccttattggtacgataatcccatatttcgggtcttcaatctgtattgggcttgctgtaccccatttacaatcaagaatggctatttgattgataaaccaaacctccgctttaaaaggtgtctgcccattgaagggaagatttatcagtttacccaataacggaatgttctccgtttttaaagtgtatgtaccacaaataaattcatccaaaatcacaccgccttttacaaaaaaagctgtctgagttggatatacaaccaattgcgaacctaatcgcaaattttcaggcgaaaacttgtacacaagttccttgtcgtttacctcacacttaattacatctacaaggttcatcgtatttcatattttttattatgaatataaagaaacaaaggaaaacaaacagttattgaagaaaaaacaactcctacccaataatcatccgcaaggaaactaagaaagaaaaaagaaaagaaagaaaaaatgagcgacaatattacagatgataaatgaggagcatcccctttcaccaccttatcaccatctaattcaatttgtaacacatgtttagtttgattatcataaaacaaacgtagcttattctctccatcatattctattttatcatatcggcaaggtataatttcctcacctgcataatttgatattccccaatattgtttttttacaagtaaccaattatcagtcaaacgtatttcctcataaagaattggtaatatttgaatcggataattacttgaaatatcgtacaatcctctgtatttatcttctgttacttcaacgtatttgcctattagccatatatttttataaatacaaggaaacataacttctccttctcgaatgttgcataatccgcttttatcgttttcactaaatataaggtaactaccaccttcataataagaaaaccgttcatatttacatggcaacagttctatttcactattgccattatataagccatatttgcgaaccctcctcaattcattacgaaccgtagcaagtacattttttgctgtttccaagtaaaagcatttaccatcttccaaacgataacttttaacgtcaatccaatcatattcaataggaactaatatcttctttgacttgatactgtacgcccccaacaatagtttttctccattatttcgcaaagacatttttttgcctataatcacaaagggaagaactatacgcacactatcatattcaaaaggaacaatttgcaatccttctgaatccaacacaccccatctcccattttctgcattttgaacagccctaatggtttcttgttttgaagtgtgtattgcgtcttttttttctccatctactttaaaggatgttgaagaaacaaagtttccacaatattcacacacagaaccaacagtaaccatcccaccacaaaagggacaagttattttttcatgtgccataatatccgtaaaaatctgtttcccgtaggctcaaaaaggaaggattataaaaaagaagtgtgagcctgaatagacttattcccaacctttgattggctctcgactgccgtgtaacaaattgagtaataagaaaaacagctcacacctttggctgtatatgttgtttaaaaacatatataacaaaccaaaggaagaacgttctttattattccatgttacacaaagatgaggtgtcgagattcatcaaagtggaataaagctaaaacgcttcctataaattattatgtctgtcattgcgatgcaatgacaatgcaaatataaatataaaaagcgaacttagcaacgttctgtgagctgtttatttttcacaaaggtagtgttttaaagcaagataaaacactacactatatatctttgtatcaatcgttgaacttgaacaatctgaaacttgcagcctttagaggtaacaaaaccttgttcattcagtcgaattgtcatttgcgatagtgttaattcctcttttaccattgaacgaagcaatgcaaccgcacgcatgttgttgacgttattttgcgctttggttctgttggtctgattgctgtgttcaattgcctcactatgttttttcattagattttcactttttccaagctgaacacctcgttccttttttgccttcaatgacaatcgtgtacgttggcttatcaagttggcttcatattccgcaatactacttataatgtgtaatatcaagcgattcgcttggggaaaatcacaaaatgtaatttcaacatcactttccaataactttgaggtaaaagctacattacgacttaatcggtcaagtttcgccacaataaggatagaatttgtttttcggcacagagccaatgcttcttgtaatttagggcggtctgacttttttccactttcggtttccacaaattcagctattattagaccttctttcacaaaagaatgaataatatttctttgcgcctcaatccccagcccgcttttttcttgtttggtagtagattgcctcaaatatgccacatagttacccataattctacttttagttaattacttacagttactaaacgaccattcaataaatgtaagttactatcagaaatagctgatttcacacttttttaatctccgcaatacaagttccgcccataacccatcgcataagaaacgacatcagaagacaaaccttcaaactcgtttttattggacttttcatctttgcgtgcattgtgtgccacccaactcgcagctatcatagcatcaagtcttgccgctttcgcctcacgaactctaacagcatctttttcccaactccaagccgctgtcaaacactccgaccatgtgcgccccctacgttgaaaatcatttttgtaaagtctgtgagcatccttcatcacctgttgtttattatatcgtttcatatcgtcttcgttttaattacaatgcaaatatatgacatatacttaatacatgcaatttattttcgctagaaatagttaaatatatgacatttattcattttatgccatataattcctatttttgcaataaaactattgtaattatgactgaaaaagagaaaaaagaacgaacagttattcatctttatataaaagagaatgatactcaccactattttggaagtatcgccaatgtatttgaatacttttcacccgaagaacttggaataagttacggctcgttaagaaattatggactttctaatgaaaattcataccaaaatagcaaatgtatcattaggaaaggaatacttctatcaaaatcgggaaataggggtaaaaatagatagctaactgttatcacacctataaatccacactattaagtccatataaataagttataactgctttattataaggtatataaacgagatacataatataaaaagagaaaacatattctatataccgtacttgcatatttttctttaactcaaaaaaacttttttaccaattctaattaaaaaagtggtagtgatatgttctaagttgtatatttgcattgaaaatacttgaataggaatcctttcaagtcagtgcgtagataaaaggctactgcacaataatataaaatgattaataatgacaaaaagaaaatcacgcttggcgttagcgtgcaaaaatttgagagcaagcctaataattggaaaacactaacttaccaacgccatacaataacgatagaggaacttgtaaaccatatttgcgaagggcattgcatttgtcaaaacttcaaaacagtaggtaaaatatttggactacgagaaaaaacgattgccaattttgactttgcagactgcataattttagatattgatgatacttttctaagtatgaatgacttttatttatcattaaaagacgagcataagccaaccatcatttatactacatatagtaatattgataatgtaaataatagatttagactgatttatgtttttaatgaaccgataagaagcaatgaatattatagaagtatagttaatactattgtttataatattcagaaagagattgaaggttttgatttaaaagataagacatgtttgaacgctacacagcaattcgcaggcaatggcaatgataacattgtatattattataatgataatatattttgtcctacggattttggatttgatgaaaattatttttccaattcagatagtatattaaaaagagagaggaagaacaacatacaaactgacttggaaagtccgattgctaattctgaatttatgaaggacttttggagtatgggatataaaatgaatgaagaaattttcatacgtaagtatgccgaaaaatacccatttattgaagctaccccattacctgaaacagattcggatataccttatatattgctgcccgacaattatgtaaagattacccgatattggtataaagagccattaaccaaaggtgacggaacaattgtctataaaagccatgcagttaaattaaaatcaggacacagacgaaaactgttatatgatggttgtttactccgaaagataatgctacctgatattacagtagagcacttactatactgccttgtatgtgagcgcagatactacgtcgataaccaagataaggttatttccaacaagatactatatcagattgcaaaagacgcttggaatgacactaaacgaagtattaagccgaaaaaagaagaaaaacagtttgttgtcaatcccaagtattgcgaaaaacatggaataagtaaacaagcagcccgaaacatagctgccaaaatgttattagacatgcaactcaaacaattatacgatatgaatttatcagttaaagaaaatatggaatcactgaaaaatcagggcattaaaatcggcaaaagcagtctctacaattgggtgaaatcaaaaaaaatatagccaaaatttgggactcccgaaagcaaaccacatgcaaaataccccccatagggaggacttcctcctccctgagtgaggggttacggtggtagagatttatctgaattagtcaagacttaatctgacagttacgtataaaaagaataaatttgtaacgggaaaaagaacgtttcgttcccaaaagtcgaaacatttcgttttgcggattataaataccatccgttgccgccctcccacatgtttaccggcgagaaaaccggcgcccctccttctgatgcccctccgatatgttggacaggcagcatatccgacctagtggaattattgtacgggctcgacaccctgaaatgtatcaacggcggagaaaccggtatccaggaactgatggtccatttctcccgattcttcggcatggagttgaagcccagtcagtgctacaacgcctatgtggatatccgtcgtcggaaaaatgacagccgtacctatttcttcgaccgggcttccgaaaagctgaacgagcgaatcgtgaaagacgatgagcgggaacgggcacgcaagagatgaaagtttttctgtctgattcatgaccgggaacaaggtgtatgggtagaagccccttgctcccggtttctttttcctgttctagcaatgacaatttgcaagaaaatgctccaaaatttcgtatctgtcggtcaaatgattatttttgccctccaaacgattacgcatgaatataaccaatatagacgacatacgcaaactggcctccggcgatgaagggggacggacagaatacaagctgatcaccgggcagttggagcgcggcatggagacactgtgcgccttcctcaacggcgagggcggtacggtactgttcggcgtggctgacaacgggaaaatcaccggtcaggaagtgagcgacaagacgaaacgggaaattgcggaagccatccgcctattcgagccgtttgccacgataacggtctcatacgcaaacattcccgacacggacaaacaggtcattgccttatatgctgaggaacaacgctatatgcgtccgttcacatataaaggcagggcttaccagcggatagaaagcgtgacgtctgtcatgccgcaggacaagtacaaccacctgctgatgcaaaggggcggcaaatacagttgggaggcaatccccaaccccgacctgcaaatcagcgacctcgacgagaatgtcatcatcggtgcggtacgcgccggaatcaactgcggacgcctgccggaaaccaccattcgcgaagaaatacccgccatccttgaaaaattcgacctgttgcatgacgggaagctgaacaatgccgccgccgtactgttcgggcgcaatctgtacgactatccccaatgcctgttgcgaatggcaaggttcagaggcacaagcaaagaggaattcatagacaaccaaagacagcaagggaacatctacgcgctattggacgctgccatgtcgttttttttcaagcacctgtccttgtcgggtaaaatagaggggctgtaccgtgaagaaaagctgagcataccttacaaggcattgagggaatgttgcatcaacgccttttgtcacagagcctaccaccgtccgggcggttcggtgggcatcgccatttatgacgaccgcgtggaaatagagagcagcggcgcgttccctcccgacatgacccttgaaaaactgcttggcggacacagttcagagccgcccaacctcatcatagccaacgtgctttacaaaagcgagttgctggaaagctggggtcgcggcatcagcctgatgatagacgagtgccgccgtgccggcatacccgacccggaattccacacggacgggagttccgtatgggtggtattccgctatgagatggaaacggctggacaagcatccgacaagcatccgacaagtacccgacaagcacccgacaagtacccgacaagcatcgtccggctcattgaactgataggggaacacacttgctcgctgaaagaaatgatgggaatgatggaactgaaggacagggagaatttcttgggcaattaccttaacccgtctatggaagccggattggtggaaccgctctatcctgaccagccgaaacatcccaagcagaaatacaggctcaccgaacaaggaaaggctttgctggaaaggggtgagtaacatggtgaagaagaaaaggaaacacggcggacactactgcaaggtatgcggctgccacaagtccaacgagagcttctcgggcagaggacacgcgctgcacatctgcaaggaatgccagtcgcttccaaaggacgaacaggcggacatgatgcgctgcaacgaggtggaacgcgccgcgttccgcttccccatgaggcggcaggactgggaactgctggaaaaatatgccaagaagtacaaggacagggagtcgggaaaattcgcgcaggagatgctggacatgaaacggggcgtttttgtgccggaagaggacgatgaagaagcggatgaatggaacaacgacatttttcaggtagcggaaaccccgttttcggaattggaggaagacacccgtaccgccatggaggaactactggaggacaacatcaacgagtacatgatacacaaggactatatccccgaagggaaggacttgcaggacatagccgattgggtgttgaaggaaaccaatgacacgttttacttgaaagccgttcccgatgacgcctaccgcaggctggtggatgataccgtccggaagatggtcaaggagtggaaagacgacggcttggagataaagacctacgccgagtcgctcacgatcatggaaacggaacggctcgtcatccgcaaaatcacccgcaaggacacgggcgcgttgctcgccctcatgggcaagtcggaagtcatgtacgcatgggaacacggctttgacaagaaggaggtgcgccaatgggtgaaccgccagttctcccgttaccgcaaggacggctacgggtatttcgcccttgtgttgaaagacgggggcaaacttatcggacaggccgggctgatgaaaagcgtgataaacgggaatgaagcggtggaactcggctacatcctggacaatgcgtattggcacaacggctatgccacggaagccgcccgaagatgcctgcggtacgctttcgagaaactgggcttgcaagaggtctattgcagcatccgtcccgaaaacacgtcctccatccgtgtggcggaagccattgccatgaaaccttgcggcagccataccattatatacaatggaaaagaaatgccccatctgctgtataaaacggagaaaccaatgcagtaattttcatttcaattgtcaatcaacgagaaaaggacaatccttaacccggtctgaacatccagccaagttaaggattttccttttttcgcctatggcgtttttacttgccctgcaagaggtgttgcagttccgggtcggactggatgcgctgcaactcgtcggcgacaatctgccgcacttccgccttgatgcggttgtagttctcctgtatcatttccttcatgcggtcgttgccgtcggcatcggtgaagtccgtgatgacggggatgggcttgtaagcctgttcctcgcgcttcaccttctccacgtccaccacaatctcgcaatgaaagattttctgctcgatgcgctcgttgaagttgtcggccaccgcgcccacgaacatgccctgcgtcagcgtggaaatcttgctcgcgggtatcaggctctccatctgcgtgttgatggaggtggacttgtcctcccggttgatggtgacgctctgccgcttctgcaagattttgccgaaacgctcggaaagcgttttggcggtctcaccaacgacttgacccgaaaagatgtttcccaccgtgttcatcacgaccgccgcttctttgtccccataatcgcgtttcaactgcgaaaagtcctgaaagccgaggcagaccgccaccttgttgcttcgggcagtggcgataagattatccaatcccttgaagtaaatcgtaggcagctcgtcgatgattaccgccgacttcagcttgcccttcttgttaatgagcttgacaattcgggaattgtacagacccaacgccgcgccgtagatgttctgacggtcgggattattgccgacgcagagaatcttaggctcatccgggttgttaatatccaacgtaaactcactgtctgacatgacccaataaagctgtggggaaatcatgcgcgagagcggtatcttcgctgatgcgatttgccccatcaactgctcggctgcacctccctgccaagcgtccataaagggcgaaagatagttttccaactccggatagctggtgagaatagggaaaacatcctcataacgtctgttcagcaactcaatggcgtgtgggaaggtgcaatactttccatcctgataaatccgtaaaaaccagataatactggcaaaaagtataatcggactctccacgaagaagtcgccttgcttttgcacccaagttttgttcaaatttaataaaatggtataggcactttcgtaggcatcggtgatgtcctccatgaaatccgggtgaatgggattgcagcggtggctccggcgcgggtcgtcgaagttaatgacgtagaacttcggcttgaccttgtagccgtcgccgtggttcatcaggtggttgtaagcgatggtggaaaggtcgctgaacttgaagtcatagatgtacatcgagtaagatttttcaatcatctgcttgataaagctgtttaccacggcatacgactttccgctgcccggagtgcccaatacgatggaagcgcggaacgggtttaccacgttgatgtacccgtcgttccacttcttcctgtaatagaagcgcgtaggcaggttcaccgaatactcgttctccatgaggcgcgtctcctgcatgaagctctcgttttccacgttgaacacgtcatccatgaggttggtgcgcaagaggcggctcatccacgtgccggacatcaggaggcagacatagcccgccgccatcgaagcggcatagaaggctacgttggcttccacgggcagcggcagggagagcatccaccagttcaggaagaacagggccagccctgcggcaagcaccgtccaaatcctgccccacgtgattttttcctccttcacgccctttgtacccaagcaagagagagccaatagcaacagcgcaaaaagttttgtgtaaaggatatggtggaacagtccggcggtgcggtcgaaattgaccagcacccggtccacgacaccgatgtcgatgccccacagccttacggcttcatacccgtaccaatagaggtggacgaccaccagaataatgctcacggcgcggagaaagtccatgattttcgccaacgccctcaaatcgtcttcctgttgtgacataaatctgtttctgtttttaagttgaacaatatgtccgcaaggctttccccggacataagcatacctcaagtccgacctgagcctatctcaagtccgaggtgaggctaccaaaggtctgaccttagatagccaaaggtctgacctttgcttggatgccctgcggacggataatttataatcccaaacccttccggcgtttcttccgcttgcgtttgagttcgcgctcgaaggcggcttcttccgcctgtgcgcccgatgcgtcgccgccaagcaagcccaagcccgtggaatggctctcgccgtgttccacataggtatgggcttccgcctgcggttcgtcccgtgtaagggtgaacggcatcggcggcgtgtccgcatacggcaaagtgaagtgctcctgcaaggcgttggcggaaaattccctgcccagccgggagccgttcagcacacagcccgtgcggtggtcgatgaaggtcgccccgtagatgcgccccccgtccgtgtggcggaacaccacatccacgcccttcgctttgagcagggcgacaaattcatccttgcggtacgtcctgtccaatacggcagcgacggtcttgcgcgtcatgtccgccagacgcttgtcgcggatttgggcattgggatactcaaacctgcgcagcacggcttcatagccgacggacttcccgatgcaggatgccttgaagggattgccgaccttgttcccgccatcatcggtggcggaatagaccagtccgtgatactcgcgtccgttcaccatgccacgggcttcctccacagtgacgttgtagagggagagcaaggcgcggtattcgcccattgtccggaacttgtaggtagccatcaccgccttgacggtgttcgacacctgacgcttcacgtctccctgcgaggcatccaccttgcgcaaggaattgtcgttacggtgctgcctgcggtcggcggggtgcagaccgtacttgcgttccagctccgtggtgatgcgcttgctgcggcgatggatgaaatccttgttcaaccgcctgccattctcgtccacattgacggagacgatatgcaggtggtggcggttgatgtcctcatgtttgaaaattagataaggctggtcgccgtagcccagcttctccagatactcccgcgcgagactttccatctccatgtccgtcaggcggtcgtcgggatgcggattaagggagatatggatgaccttgttccgtgtgcggacgttctccggcatgtaccgtttgaaatcctgttcggcacgggcgatgtccacccgtccgctgccatcgtcgaagaccttgttcccggcgagcagcttcccctcgccctcgttcactttcatgccgttgtaagccaacgccccgtacagcgacgtgcctaccgtgatttttgcgaccatctttcctgaaactcccttgaaagttcaacgacctgccgcgtgattgcggccagttccttcgtgcattgctccagcttgtagagcaatgccatcgcctttttctccgagaaatggcagcgcagctccttgaccgtctggttatagttgttccccaccatgcggtactgcgcatggaaagcggacagcttcgtgcagtagtcgagcagcgtcttgtccgtgaccagtacccggaacggctgtccgaagaagtgcgccttcaggaacaccgccctcgcctccacgccggacttgccgtgcatagcgaggaacctgagccattccccgtcgtcgaaacgcaccatcacgcagtgcgacttgcggctttcccgtggatgccgcccccacttgggactgtcagtcccgttctttttcttgttctcgttcatattacaatggatttagtggtgtcacggcataagcgtagcttcggcaaccgcaccgcaggtggaaacaggcttcccgacttcggagaggaagccctccccgtgaggggcaaggtcgtttcgggagtaacccgaaaccctttgagttactcaaaggacaccttgctgtgtctttgaggacacaaaaatccgtggtaaacggattggggatagacctgccattacccatttataaggcatcggtcgcccgatacctttctgctgcccaaaagaaggacggagccggggtctgcggtgcgcgctttcggctttgccctgccgcttgggtgcaaaggtagggtgttttccaagtctgaaatacggctcaaaaacgccacaagctgccacgacagcgccaaatgctgccacgcaagtgaaaaaaacatagttgcctgcctgtccgttttcagatttgcgaaccggaaggcattcttgcccgcctgccagttcacctgcctgcctgtcagtctgcttgcccttgtgcctgcctgccggcacgctggcatacaggcattggagcggggaaatgccaaagagcataaaccagccaaacaaagaaactgttggaaagcgatggaggaatgtgctaagatgtccacgagactacatttagcacaagtgaaaaagagttcttcatgtttgtagtcaatatgtttgcgaatccgcaagcattcttgcccgccagcctgctcacctgcctgccagtctgcttgcccttgtgcctgcctgccggcatacaggcattggagtgctgaaatgccaaagagcgaaaatcagccaagcaagaaaactattggaaagcgattggtaggaatgaattaagatgttcatgagtccacattggccacaatagaaaaagttctacctatttgtggccaatatgcctgcgaacctacaagctagcattcttccttgccaggtggcaggcattcttgcccgcctgccagttcacctgcctgccagtctgcttgcccttgtgcctgcctgccggcacgctggcatacaggcatcggaatggtgaaaatgccaaataacggccacaagccaaacgcaagatgagtggcgataaggccgggtaaagaacgccacaagctgccacgacaacgccaaatgctgccacgcaacggcaaaaggatacaacctttgagaaagcccctttcctttgcaggcgaaacggtcggcacgcctgcctgcttccgggctgacatccttgccaacctgcctgccagtccgccagcccttgtgcctgccggcacacaggcatacaggcaaaggcttggtggaaaggcaaagggcggatgccgtttcaatgggccaaacgccaggaaaagcggtggaaagggtggccaaagaacgccacaagctgccacgacaacgccaaatgctgccacgcaacagcaaagagacacaaccttggcgaaagtcattttcctttgcaggcggaatggtcggtatgcctgcccttatgcttgcctgccggcacacaggcatggatgggaacaggcataccgggagggatgccggactgcctgctcgcttaccgggcggatggctgccgaccggaccaagaaacggatgtctaacaaataaaaaagaagaaagcatgaaaaaagaacctttgttcatcgccttctccacccagaagggaggagcaggcaaaacgacactcaccgtactgatggcgagttacctgtattacgtgaagggatatgacgtggcggtcgtggactgcgactatccccagttcagcatcaaggacatgcgcgaacgcgacttgaaaagtatcgagcgcaacccgtacctgcgcaagctggcatacgagcagttcaagcgcatcggcaaacgcgcctacccgattgtggggagccgtcccggcaacgcgattgaaacggtcaggccatttgtcgagtcggcgacaccgcccgacttcatcttcttcgacctgacgggtacggtgaacaacctcgacctgatccggacagtagcgacgatggactacatcttctgcccgatagccgcagaccgtttcatcatggaaagctcgctgaagtacgcgggcgtcatcaacgacacgctgatcactaccggcaagtcgaacatcaagggcatccgcctcttgtggaacatggtggacaagcgcgagaagaccgacctgtacgacatctatgacaaggtgatagccgggatggggcttgaagtgctggacaccagtctgcccgacagcaagcgtttccgcaaggaaggctctgaggaaggcgaccgcccgtttttccgctccacgctgctgccgccggacaaggcattggcgaaagggagcggcatcgatgccctcgcggaagaaatactcggcatcgtaaagcgttgaaccgatggccaagaaactcgatgtcgatattgaccccggcaagttcctggattcgttccgtccggaaatgcccgcgcccgcctccccggggagcctcggaacagatggcaacacttccgcaaaggaggccaggctggcggaaaaaccgaaagcaaaggtgggcaaggatgccacggaaaaggaagaggaatacctggaacgcttcctccatgcaccgagaatccccgtgtgttcgggcaagaccgcctacatccgcaaaagctaccacgagcggatacagcgtatcgtgcaggtcatcgggaagaacgggcttacgttgtcggtctatgtggaccgtgtgctggagcagcacttccgcgaatacgaggaagtgatccgccgactttacaagaaaaattacgaggacatttattgattttattcaccctaaaaaacgaaaacaagatgggatttttcaattcgagaatgaaaaagaaggggaatggcaacccgaaggcggacactccccaagtgaacaatctggaaaaggcggacgtagtcatccacattgtggacgacacccaattagaaaaagcggcggtgttcctccgctatctgacgcccagacaaggagcgcaccgccagtgcatttacctcagccgtgagatgcacgggaagctgtcccgcattgtgcggacactgggcgggaacggcagcaccattggcgggtacatcgagaatgtgctggaagagcacttgcaaacctatggggacgacatcaatgccctgttacgccgtgaaacctcgcaaccgctctgacgatggccgagctgctcatcgtgctgatgatggccttcaacctatggatggtcatctacctgacttgggaacgccgggaagaaaacgtacccaaggaggacaaggaaaaggatgtgggcgcaccggaaaggtccggcgacatcatggggaaaagcctgttccggatgcctgaacgaaaaccgcaggctgctgcaccgatgtccaatgccaccgtgcaagcccccggcgaggaggtggacgagaaggacgtggcctttgacgatgaaactgcctcccccaatagccggctttcgggagccaggccgtcgcgccaagtgcccgacgaggaactggacgaggtgtttgccgacaagcgtgtttccgacatcggggcggaatatgacgaagacggagatgatgacggcgagcctcatgaagcgggaggcatgaccttcgaggacatcgaccttgccatgcggacggtgaagaaaccgaaagccacgaaagaggaacgccgtcacgccggaatggtgttctgcgacatgaagggcaacgaactgttcgcgatgatagaaaagagttcggaagcgacccgcaggaaactggacgagctgatggactactatctggactccgtgtcggcggcgcaggcaaacactacaccggtgattatgcccaagaaagcgcccgcagttccggacaacttcgaggacttcaacatccgcgactatgtataacaagtaaaaacgtaacagcaatgcgaaaaaagaaaatcgactacggctaaaccatcggcttgccaccgagaccactaaatcccaaaagccggcttcatccaaagccgcaagaattaaaacaagtatcaaccgccaatgggaacatccaacccggaggcacaaaacagaaaagattatgacaaagacattgaagaaaaagcaaatcatcctcgcggccctcctgctggctgccaacatccaagttttcgcgcaaggcaacggcatggcgggcatcaccgaagccaccagcatggtcacttcctactttgacccggcgacgaaactcatctacgccatcggcgcggtcgtcgggcttatcggaggcatcaaggtgtacggcaaattcagcgccggcgaccccgacacctcgaagaccgccgcaagctggttcggcgcgtgtatcttcctgattgtaagcgcgaccatcctgcgctcgttcttcctctaacaaacgggtatcctatacatatataataaggtataaggacaatggctgagtaccccatcaacaagggcatcggccgtccggtggagttcaagggcctgaaggcgcagtacctgttcctgttcgcgggcgggctgctcgccgccttcatcctcttcatcatcctctacatggcaggcgcgggccagtggctctgcatcggcttcggcgcggtatccgcctcgtcgctcgtgtggctcacgttccggctgaacgcgaagtacggcgaacacgggctgatgaagttgggcgcggcacggatgcgcccacgccatgtgctccaccgcagacgggtgtccaatctgttaagacgaaaaaagaagaaaggaagaaacgtatgagaaacatcatgaaagccaccacgctggaaagccgcttccccctgctttcggtggaacacgggtgcatcgtctcgaaagacgcggacatcaccgccgccttcgaggtggagcttccggaggtctataccgtcacggcggaggaatacgagggcatccacgccacgtggtgcaaggcaatcaaggtactgcccgaccattcggtgctgcacaagcaagactggtacgtgaaggaacggtaccgccccgacctcggcaaggagggcatgggcttcctcgcccgcagctacgagatgcacttcaacgagcgcccgttcctgcaccacaagtgctacctgttcctgacgaagactacgaaggagcgcatgaggcagcagagcaactggaatacgctgtgccgggggcatatcgtaccgaaagaaatacaggacaaggagacggcggtgaagttcatcgaggcggtggagcagttcgcgcgtatcctgaacgattcggggcatatcaaattgcgccgcctctccgatgacgagcttacaggcacggacaaggagacgggcatcataggcaggtacttcgccctgtcgctgggcaacgcggactgtctggaggacatcgagatgacggcaagggaaatgcgcgtcggcgacaaccgcctgtgcctgcacaccctgtcggacacggaggacctgcccgcagcggtggccacggactgccgttacgaaaggctgtccaccgaccgctcggactgccgcctgtccttcgccgcgccgctgggactgctgctgccctgcaaccacatctacaaccagtatgtcttcatcggcaacagcgacgaggaactgcgccgcttcgagaaaacggcgaggaacatgcagtcgctctcccggtacagccgccagaacgccatcaaccgcgagtggattgaagaatacctgaacgaagcgcactcgcaggggctgaagtccgtccgcgcccacttcaacgtgatggcgtggagcgacgacgcggaggagctgaaacgcatcaagaacgacgtgggcagccagatggcaagcatgggctgtgtgccgcgccacaacacgacggactgcccgacgctgttctgggcgggcatccccggcaacgcggcggacttcccggcggaagagtcgttccacacgttcatagagcaggcggtgtgcctcttcgcgggcgagaccaactacaaggactctccgtccgccttcggcatccgcatggcggaccgcatcagcggcaagcccctgcacatcgacatctccgacctgccgatgaagcgcggcgtgacgaccaaccgcaacaagttcgtattgggtccttcgggcagcggcaaatcgttcttcatgaaccatctggtcagacaatactatgagcaaggctcccatgtggtgctggtcgatacgggcaactcctaccaagggctgtgcgagatgatacaccgcaagaccaagggaaaggacggggtttattatacctatacggaggacaacccgatttcctttaatccgttctacacggaggacaaggtgtatgacatcgaaaagagggaaagtatcaagactttgttgctgacgctgtggaagaaggacaatgagcctgctacccgtgcggaggaggttgcactttccaatgccgtgtcgcagtacataggacgtattaaggaagacaacagcattgtcccatgcttcaacacgttctacgagtttatagacacggattatcgcaaggtattggaagataagaaagtgcgtgaaaaggactttgacattgccagtttcctgaatgtgctggagccgtactacaagggcggtgaatataattacctgcttaattcggacaaggaactggacttgctacacaagcggttcatcgtctttgaaatcgaccagataaaagagcacgccatcttgttcccggttacgacaatcatcattatggagttgttcatcaacaagatgcgccgtctgcaaggtatcagaaagatgataataattgaagaggcttggaaggcgattgcttcggcgaatatggcttcctatgtaaagtatctttataagacggtcagaaagtatttcggcgaggcaatagtggtgacgcaggaggtggacgacatcatcagctcgcccatcgtcaaggagtccatcatcaacaactcggactgcaagatactgctcgaccagcggaagttcatgaaccgcttcgaccagatacagggattgctggggctgacggaaaaggagaagtcgcagatactttccatcaaccagtccaacgattcgtccagacgatacaaggaggtgtggataggcttaggcggcacacagtcggcggtgtacgccacggaggtgtccatacacgaataccttgcctatacaacggaggaaacggagaagatggaagtccgcgaactggcggggaagctgggcagcgacatggaagccgccatacggcagattgcggagaaacgtatggacgaagaaaagtaaccgatggaaacatcacccgaccacagacggcgtttgaggccaccttatacggcatataagggtgtatcaaacggcgtatgaggtcaagacacattttatcaacaaaaaaacaagaattgaagattatgaacattgaactgacaaagacacaacggctgctgctttgcggcggtctgataggcttggcgtcgctgatgctgcaagcctgcgagacggtaatgaaagaaaacgaagacatccgcgagaagatttgcggcaactggcagagcgtggagggcaagcccgacatattggtgtacaaggagggcgcactttacaaggtgacgctgttccgcagggcgggcgtccaccggaaactgaagccggagacctacctgctgcaaagggaggcggacggtaacctctacctgaacacgggcttccgcatcgacgtggcatacaacgaggaaacggacatcctgtccttttcgcctaacggcgactatatccgggtgaacacggatgaaacagccaatggcgaaaagaagaaagaacaataagaatgtaccactaaatccaatgtgaatatgagacaaaaactgaaaatgccattggtggcagcctgcctgtgccttgcaggtgcaggcacggcaaacgcccaatgggtggtgtccgacccgacgaacctcgcgcagagcatcatcaactccgccaaggagatggtggaaacggcgggcacgaaagccaacacgctcaacggcttcttggaaaccaagaaagtgtttgagcagggaaagaagtattacgacgcgctgaaatccgtacatgacgtggtgaagggcggcgtgaaggtgtcgaaaagcatcgggttggtgatggaaatatcagaaatctatgtggataactaccagaagatgctctctgatgagaactacacgccggaagagcttgccgccatatcgtcgggctacaccatgctgatagacgagagttcggacgtgctgcaagacctgaagaacgtggtgaacgtgacggggatgtcgctcacggacgcggaacggctggcgattatcgacaacgcctaccgcagcctgatgaactaccgcaacctcgtgcgctactacacgaacaagaccatatcggtgtcctacctccgggcaaggaagaagaacgacatggaccgggtgataggactctacggaaaccccaacgaaaaatactggtaagttatgggagagttcgacaaccttcaccagatactcctttcgctctacgacgagatgatgccgctgtgcgcggacatgacgggcgtggcgaaagggcttgccgggctgggcgcgttgttctacgtggcggtgcgcgtgtggcagtcgctcgcccgcgccgaggcgatagacgtgtacccgctgctccgcccgtttgcgctcggtttgtgcatcctgttcttcccgaccatcgtgttgggtacgatgaacagcgtgttaagccccatcgtgcagggcgtacacggcatcctcgaagaacagaccttcgacatgaacgagtaccgggagcagaaagacaaactggaatacgaggcgatgatgcgcaacccggagaccgcctacctcgccagtgatgaggaatttgaccgccagttggacgagctgggctggtcgccctcggacttggtgacgatgacggggatgtacatggaccgggcggcgtacaacatcaagaagacggtgcgtgactggttccgggaactgctggaactgatgttcgccgcagccgcgctcatcatcgacacgctcaggacgttcttcctcgtggtgctgagcatcctgggaccggtagccttcgcctttgccgtatgggacggcttccactcgacgctctcggcgtggttcagccgctacatacagatttacctgtggcttcccgtgtcggatttgttcagcaccatactggcgaagatacagattctgatgttgcagaacgacatacaagcgatgcagaccgacccgaacttctcggtggaggcgagcaacggggtgtacatcgtgttcctcatcatcggcatcgtgggctacttcaccatcccgacggtggcaggctggatcatccaagcaggtggcggcataggcagctacaacaagaacatcaacaccgccggggctttgggcggcagcgtggcgggagccgccgcaggaaacgtggcaggccgcgcgggcaagctcatcaagggaacggcgggaaagctgttccgaagataggcattccggacaatccgtttccgtgagttgcccgacccttaaaaacggattattgaacaattaaaagacgaaaagaagaaaatggaattcaaatcactcaagaacatcgagacgagtttccggcagatacgtctgttcggcatcgtctatacggcggcctgcgccctcgtggtggtctgctcggtggtgtgcgccttccgcttcgccgaggcgcaacggcagaagatatacgtcctcgatggaggcaagagtcttatgctcgcgctctcgcaggacctgtcgcagaaccgcccggcggaagccagggaacacgtgcgccgcttccacgaactgtttttcaccctctcgccggagaaaagcgcgatagagcacaacgtgaaacgcgccctgctcttggcagacaagagcgcgtacaactattacgccgacttcgccgaaaagggcttctacaaccgcatcatcgccgggaacatcaaccaagtgttgcaggtggacagcgtggtgtgcaatttcgaccgctatccctacgaggcgcggacatacgcccgtcagatgattatccgcgagagcaacgtgacggaacggacattagtaaccgcctgccgcctgctcaacgcgagccgctcggacgacaacccaaacggcttcaccatcgagggcttcacggtattggagaacaaggacatccggacgattgaaagataatgcgtatgggaaagatgaaaaatctcattgaaaagtggaccaccgggctgaaaggttggttacgcaataggctggacgccctgccgcccaaagcacggcttaggatagtccttgcggcatttgccgtgttcgcctcgctctgtctctacatgactgccgccgcaatcatcggcttcggcaaaggggaagaggcattggagatacggcacatcgagaagttagaaatatataataaggtgtatcactcaaatttgaatccacaatgaaattatcagattggatatgggaaaagatggaaaacttgcaggatgccggattccgatggaaaccgaccttgaagttctgccatcaggtgcttcgcttggattacaatgccattgccgattccatcgtaaggaacgggcatcgcccggcaattacggaagagcaggcaaaaatactctgggattaccgtttcttccggaatctggaccagacggaacgcagcggctggcacaaggttatggatgtactgcaacaaaccgattggggcaaacagcaggtctggttgttgtccggattgaaaatggggaatgaaacacttccccaaaaactgaatgccatgtacacgctgctttgtagtgcccatacgggtaaaagccataccctatgtcctctgcccaatccggaagaagtggctaccgcccataagctggtagggtattgcatgaaggacgaggaactcgactacttgaagcggcttgccctgcatggggaatatccgggagacctgaccgccatcaggcatggtctgatggatatgtaccaaaagatagaggacctcgaatgggaacgggccaaggaaatgcgtgcggacaatcactggtcggcggactccatcgatgcggccatccaggaggaaaaaggacggattatgcgcagtgcctccgatttgtacgagcagaaagtgcagggcaagttcccggacgactatcggaaagccctgcaccgggaacggatggtgcttcatggactctctcaaaagggatgggacgggcagacaaaaattccgaaacctctgttggtcaagtatgggttggcggaatcattcggaaaaataagcgatgcgttgatggattacattatccgttgtgacatgggagacgatacttatcccaagcatatggtagggcatcataaccgcatcatcaaagaacagtcccggataggattggaacgcttggaacacaggttgtttccggataaaaacaaaccaaagctccatccggcttctttgggtacgcataaaatgcccattcgcttacagaatcaggtaagcaaagagaataaaggtataaaaatcagactttgacaagctaattgaactgatgatggaaacaaaagaacagaagaatgaatcaagaacaaaagagaaaaagccgctgacggaacaacagcgtcagcaaaggcagaagatgctggtctatccgctgatggtgctgctgttcgccgggtgtatgtggctcatcttcgcgccgtcctccgaggacaaggagaaagaacggcagggacagggattcaacacggacatgcccatgcccgaagactccaaaatcatcggggacaaggcgaaagcctacgagcagcaggatttggaaaacaagcggaaggaacgccggggcatggtgggcgacctctccgcgttctggaacgacagcgacggtgacacgccaacggacgatgccgacacttcggacgattaccgcctgacacggacggaaacgaccgacggggaaacggcggacgaaagacaggcgggcatccgcacttccgctgccgcctaccaacggctgaacacctcgctgggcacgttctacgagccgccgaaggaggacacggaaaaggaggaactccgggagcgcatcgacgaactggaagccatgctggtggcgcaggatagcaagccttccacgatggaggaacaggtcgccctgttggaaaagtcctatgagctggcggcgaagtaccagaatgacaacaatgccggacaagccgcacagcccgatgaaacgggaggttctgtgagtacaggcgaaaagagcatgaaggcagaacccgtaagcgatgtaaggcggacggtggtgtccgccctgccgcagcccatgacagactcggcgttcatcgcggactattcgggggaacgcaactacggcttccacaccgccatcggtgcggaggaaacgacggggaagaacaccatcgccgcctgtgtgcagggcgaccagacgctgacggacgggcagacggtgaagctccggctgctggagccgatgcgcgtgtcggggcgcgtcatcccccggaacacgctccttgtgggcgcggcacggttgcagggcgaaaggctcggcatcggcatcacctcgctggaacacgggggaaacatcatcccggtagaactggaggtgtacgacagcgacgggcaggcgggcatcttcatacccggctcgatggagatagacgcggcaaaggaaatcggggcgaacatgggcagctcgctcggaagcagcatcaacatatcgaccgacgcgggggcgcagctcgcctccgacttggggcgaggggcgatacagggcatctcgcagtacatctcgaaaaggatgcgcacggtcaaggtacatctgaagtcagggtacagggtattgctctaccaagaaaaggaatgaacagtccaaaaacataaaggcaaaaaaagaaaaaataatcaacaaactaatttttatttaccactaaatccaacgtaaaatgagtatcaagaaagtaatgacaatgtttgccctgctgatgggcatcgcctgtgcgagctacgcgcagggagtgacgaacgacagcactgccaccgccaaggaggacgggctggaactggtgaaggacgtctatccgcagacggaggaggacggcgacctgtaccacggtctgacgaaaaagctgatgttcgaccgcatgataccgccgcacggcttggaagtcacgtatgacaagaccgtccacatcctgtttccggcggcggtgcgctacgtggacttgggttcgcccaacctgatagcgggcaaggcggacggtgcggagaacgtcatccgtgtgaaggcgacggtcaagaatttccgcaacgagacgaacatgagcgtcatcacggaggacgggtcattttacacatttaatgtgaaatacgccgatgagccgcttatcctgaacgtggaaatgaaggactttatccacgacggcagcacggtgaaccgaccgaacaacgcgcaggaaatctacctgaaggaactgggcagcgaaagcccgatgctggtacacctcatcatgaagtcgctgcacaaggaggacaagcgcaaggtgaagcacatcggctgcaagcgtttcggcatccagtacctgctgaaagggatttatgtccacaatgacctgctgtatttctacacggagataaagaaccaaagcaatgtgccgtttgacgtggactacatcacgttcaagattgtggacaagaaggtggcgaagcgtaccgccatgcaggaacaggtgctgttcccgctccgcgcctacaactacgccgtccgtgtagccgggaagcggtccgaacgcacggtgttctgccttccgaagttcaccatccccgacggcaagcagctcgtggtggagatgaacgagaaggacggcggacgccaccagacgtttaccgtggagaacgaggacttggtacaggctgaaaccatcaacgaactgcgcgtgcgatgaaaggaaaggtactgtttattgtaacgcttctgttcgtcctcctggcaggacgggcggaagcccaacggtgcctgccgaagatgcggggcatcgagttgagagccgggctgaacgaggcggacggctatgtgctgggagccatgctttcgagctacgcgaaaggtgggaacaagtgggtgtacgggctggaatacctgaaaaccagccacggataccggagtacgaccatccctgcggcacagttcacggcggagggcggttactactacaacttcctctcggacgcgaaaaaggtggtgttcttctacgctggcgcgtcagcccttgccgggtacgagacggtgaactggggcggaaagacgctgtacgacggggcgaggctgaacaacaaggacgcctttgtctatggctgcgccgccacgctggaaatggagctgtacctcgtggacttcattgcgctgacggcctcgctgcgtgaacgcttcctgtggggcggcagcatgggcgtgtgccacacggaatacgggataggcgtgaagttcatcatcaactgaatgtgcgcctatatggatatagaagcgatgaaacgctatccgctggaggacttccttgcacggctggggcatcatcccgtgcaaagacgtgccaacgccatctggtacaggtcgccgtaccgggaggaacacacgccttccttcaaggtaaacccggaaaagaacctctggtttgattttggcgagggcaagggcggtaacatcttcgcccttgcgggggagttcatccaaagcggcgacttcctcacacaggcgaggtatgtggcggaggtggcggacatgccgttgcaggactatgagcaacgccgcacccccgaagtgcggcaaccagccggacacagcttcgaggacgtggaagtgctgcccttgcagagccgggcgttactccattacctgcaagaaaggggcataccgtccgccatagccatcgcgaactgcaaggagatgcgctactccacgcacgggaaacggtatttcgccgtggctttcggcaactgcggtggcggctacgagatacgcaacccgttcttcaagggctgtgtgccgccaaaggacgtcaccctgctgccgtcaggctctgccgtttgcaacgtgtacgagggctttgtggactacctttccgcccgtgcattaggcatcggcggcggggaggaccaccttgtcctcaactcggtgtccaatgtggcgagggcgtaccggcatctggacggctacggaacggtgcggtgccaccttgacaacgacgaagccgggcggcggacattggaagccctgcgcacacgttacggcgaaagggtgtcggactgctccggcatctacggcggatgcaaggacttgaacgagtatctgcaaagccgtctgaaacaaaacgagaagaacaacaagaacatcaaacttaaaatgtaacggttatgaacatgaacaaattaaacaatacacggaaagtgaaaagaaacatagtaaaatcattggcaaccctttgtctggggctgctctctgtatgcttcaccgcctgcgatgacgatttggacgtgacgcaagcctatccgttcacggtggaagccatgcccgtgccgaaggaactggcgcagggcgagacggcggaaatccgttgcgaactggtacgcgagggcgagtttgacggggcggtctataccatccgctatttccaatacgacggggagggcacgttgaagctggataacggcttggtgttgcagcccaacgaccgctacctgctggagaacgaaaaattccgcctatattacacctcggagtgcgacgagtcgcaaagcctgaccatcacggtggaggacaatttcggcaatgcctgcgagtgggaattggagttcaacaacgactcggacgcggaaacggagggaggcgtcgctgtgtctgacaccttgaacgccagccgatgatgcgcaaggcgttgctcctgctgctggcggctgccctctgtggcagcctgccggcacaagacacggacagcatggcggaactgctggcatcgtttaacaatcatcccaaggctgacatcgccgttgaactgataaaaaagtacgagggactgcacgaccgttccgattacccctactacggctacgggcatcgcaggttgcccaacgaaaacctttcctatgacatgacggaggcggaagccgaagccctgctccgcaaggatttggcggtgcgctacaagctgttccgcaaatttggtaaagatgccttgcttcttaccgtattaagtttcaatgtgggtcaaggggtattgcttggtcacggcggacacccgaaaagcaaactcatccgcaagctggaagccgggaatcgagacatttaccgtgaatatatcgcttactgccggtacaaaggaaagcagcacgccatgctattcaatcgaagaaaaacagaatttgcgttgctatatattccgtgatatgattaaaattccttgcggtaaataatttcgcaaggaatttttgcttccaatacaaataaacatattatctttacaaataaattttcgaaaaatgaaagagccgaaagaaatctattatttacctgtagaacagttatctgatgatgttattcaatatattgaaaaagtttttgagttattagatgctgtaaaaaatgattgcaatagcaataatttttctcgccgatttactttcataagagatgagaaagctattagtgatgttgcggaaattaaaaaagataataataaattaaatcatatatatatcaacgaaaatttctgtcagtatttatggtctgtttgtgtctatcttatcgcatattttgaaaatgttatacatatccctatgatggatgctgttggtattaataaaaatggatataagcccaatatgatagatgtagaatatggcaatgattgttttttcagaggacggcaattattacataactttaatagagatgcatattgggttactccaaatatctgtaatccgcagcaatttgaaaatattataagccatgcgaatgatgtctattgtgctgcaatagcatttatatatgctcacgagttttcacataattatttggggcatacacaaatacagcaaacgctttctcgttcaataaatgatgaaattgcagcagatgatatggcaattagctttattcaaactgaatataactctgcatggggaagaacctataaggcaggaattgcaactacattagcagcccttttattaatgggagaggattctatttctggtggtggaacccatccagatatggatgttcgaatagaaaatttggttactaaactggaattgcacgaaatggatcttctttggggctatttaggggttgctttaagattatggcttcttgtttttgatggcttatccatcaaagaggatatgcagcaaccggggtttggttcatacaaagagatatatttatattatatagaaaaattaaagattgtcaggcaacaacgttatcctacaattatcaaaccagactgggatatataattaatgacttcattggatttttccatcttatcgaagatgggggcaacggtttctttgctactttcttatccgccgacctgctcatgaaagaaagtagcgggcggcaagcctgccgcccgattttaccgctttatcctttgcagcacacgctcaagtgtgcgctcggcaatggggcgtgtgtccttgttccaaaggttatacccgtgtacggatattcccacgctccgcaaatctcggatataaccggacgcttcatcttgcgtgggcaggtaaacgaactgcacccatgcgtccctgccgtctgtcagtatgaaatagtatttcatttcgcttgttttttcagttgttacgaatggagtgtgggcggtgtttccaccgccacgcactcaaaattcctttatgtcggcgatagccgtgcagcgtgtgagccattcctttacgcagggcatgttgtattcggaagtgatgactgccgtatgcccgtttatctgcgtaaacctcgtactttcatagtcctccacccatcctttgaggctgtccgttccccatgcgtccgcatcggcgaacatattgtccaaaaccttgatagggtcgctgaacgtcactatcagcgtttcatatcctgcgctcatcgtctgccctccttcgctttaatccattcgtcacgcaaccgcctgcactcgtccaatgtgggtttcacgcaggagaacagttctcccgttgtggtgtcccgatagtcatattggtacatcgtgcggactttgcgcccgattttcagttggaatttctcgtatttctcacctgccgtgcaggtgcttactccgttaatagtcattcttgttgtcatagccttatcaattaaaattcaacaatcagtaatctgttctccaaacattggtcggggtcggatgcctttttctgtgtcacccacagatggtgtgcgccatacccgaatgcgaaaagggcgttgaaaagtttctttcgggcgaacacctccattaccccccttacatcctgctcgtcctttgtcagtacaagcgtgttcaacaattcgatgaacatttcaggcagtttctcgtgccacccgaaaatcatgttttctattctcacttccatatcaataagtattaagttgttaaacgattacgctgcttctttcatccgtttccgtatctgctcggcattgtcctccaccaatttgatgatgcggtcgtggtattcggtgttggagttgcatacgccacggctctgcaccacttttaatgtccgcaagtccacctccactgtctcgatgcgtcgctcgtctatccgtgcggaaagtatcagggagttctcattgttgtagtaggcgttggcatagacgcaatggtgcatggctttcccctcctcgtagaactcgtccacgctttgcagcaccttgacgatgattagaccgtccgtcagtacaaggttgaggaatgcggctttctttcggatatactcgtctttctctttcgccatttcttccagacgcttccgctcacgctccaaccgctcggcttcccactccctgtgttgctgctgccgttcacgctccaattggacttgccgtttccccatatacaggtcgtgagccgccttgaaatcgggcgggcatatgaaacgggggttgcgcaaatcttttcccaatctctctaagagatatacgaggtcgcaccacaatgagatgtcggttatggcatatttattccgcatggctatcttgtacgagttccaacatctgtcaagtacctgcggacgggagaggaaatagcgcaagtgttcgatgttgcccgacttcagcaatgtttccgcacggctgtccgaaaggatagccttgaagaagtcgtaaggcagtatgccgtgcaggttgccgtcaaagccatttcgcttaatttcggggataatccgtcggcgtggataggtgcatatcgggtcaatgtcatacaccttatgctggttgttcctgcggatttccatcgggctgtcctcgttccacaagtcgtagtagagaagtgaaaagccacgcaaccttgccactgtctcggacttgccgtcaggagcaatccaccgctgtgccacctcaaagatggaatactccgccttttgcccgactttctgacggctcctgacgaaaaagaaacgtattacctggtagcctttgcaggtggtgatgatggagaaatactcgttgtccacgaacaccctctttcgggtgtccgtgatttccaatgccgtgccgcagttcgggcaggtgcatccgcaaagcgtgtcggcaaggctgtgtccgcttttccatgcgtgtccgcactccgtgcaggtaatgacgccttttgcagtccgcctgccgtagtgcttgaaacaatggtggaaagcgtaggttctctgtgcgtttgtcagttcgggcagggttgcgctcagacggatgacttctttctgtatgggtgtcttgggtttcataggttcagaataatgaaagttcaacttgttgtgcgtttgtcttttggttcgccttagccttgttccggttttgcatcttgcgcagttcctcgtcttggtattggcggatggctctctgccttgcttccgccttttcctcgtccgtcagttcaactccgcataccatgacttggcacgggattggtttgccgatgtcgatgtcgtcctcgtcaaaatagtgtaccgcttgcgacaagacttcccctgcggtaacgcctatgccgttgcctccattgcattggcttttcgcccaatgcaacaaataggtgatgcaatcgtccatgttcttgttcggcttgctgtaacttgctgcaaacagcttgtcctccgccgcacggctgtccaaataggcttggatggtccgcttgaaatggtctgttccgttcatatctgtatgtattttagttatttgaaaaattctccgttggataaaaactcgtattcgttggcttcgcaatcacgctcaaaggcttcctcgttgctagcatattccacatcatccctgcaaaagcggaaaaagctgtcgatgcagtcattcatcaagtcatacaagttcgtatgcttgtcggggactttcagaaagtcgtatatgggtttcagtatgtccatgtccgcacaataacccgtcagcacacaatcattggttacggatatccgacttctgcgctgtttgtggaagtcctttttgtgccaataggtcttgggcttgaaaaggttgtgccaatagttgttcacgatgaatttcagcaaccgcacaccgcacagttcttcctcttccccgctgtaatttgagatgaattggaaattataggtacaggcatcataattccacctgcttacctttaccttgaaaatctcctcaaaggctttcaacgttgccctgttgtcgggcagtgctcaggcagtgtctgggaatgcagtcggcactcagtagttatgccgcgaaacatcatacaatctctatctaattgaaaattaaacagttatttctgtttaattaatatcaggtaacgatttagaaacgagcgaattacaatattctgttttcttttgcctctgtcaaagaacgattctttcaatgcaaatatacactttacttgtgacaaaagcaatctttttctacatttaatcgacttacagtcagccttaaagagggtatctggtctcattccatcttcttcctcaaaaataacatagcagtctaaattggtttatgtatgggataggtcttgttcattcgatccggtagactactatacataaaagtataaaggcgagatacgacaaggagatgccatgcttttgtgtaaggggaatctctcttagcttatcgcagaccatgtatagctaagtgttttgagaataaacagtctgtaaaaaacggaaagacaccgattatgggccgtatcaccatcaatggaacccaagccggtttcagttgtaagaaagaaatgtccctcgctttgtgggacgtcaaaaccaaccgggccaaaggcaagtccgaggaggcccgtacactcaatcaggagcttgacaatatcaaggcgcaaatcaccaggcactaccagtacatctgcgaccacgacagttttgttacagccaagaaagtctataaccgctatgtcggcttctcagaggaatgccacacccttatgaaccttttcagggaacagctggaaccgtataaaaagaaaatcggcatagagaaagccgaaagcacctactgcggtctggttgccgattacaagagtctcctgcttttcatgaaaagcaagaagaatgcagaggatattgtcatcgaagaacttgagaaatcattcatcgaggattactacaactggatgctcggtacatgcgctttggcaaactccactgtcttcgggcgtgtcaataccttgaagtggctgatgtatatcgcgcaggaaaaaggctggatacgggttcatccgttcgcatcattcgagtgtatgcccgaatacaagaggcgttctttcctttccgaagaggaactgcaaaggataatccatatagaaccgagatacaaacgccagcgtgccatgcgcgacatgttcctgttcatgtgcttcaccggtctttcctatgtggacttgaaagccataacatacgataatatccataccgactccaacggcggtacatggctgatgggcaaccgtataaaaacgggagtggcgtatgtcgtaaaattattgcccattgctatcgaactgattgaaaaatataggggtacggatgaaaagaaagactccccgaatgtgtctttccggtaggtgaatacaatgccatgcggctcagtcttggaatcataggcaggaaatgcaactccggggcgaggtcaccccgcacatcggacgccacgcatttgccgttctagccatactcaaggggatgctgctggaaactcttcagaaagtgtttgggcataagtccatcacatacgtcctgcgcatccattcacttgtccggcgcaggcggggcaatctttttctggaagtcgcccatctgtacgaccagcgtgctgaccagctttctcaactcctaatacgcgcttgtttcaataattgtcagttccatactaaaattctttttaagattctgaatatgcgacaaagtaacgcacatcctatatcctttccaaacagataatatcagagtcttccgttggcgtgcattggcgtatccaacgttaaaagagaaggtccttcacctgcatccatgcggcaacggaacttccattcccttacttgttttccataaatttataggattaatttctggtgcatgatattaatagtcattattctgtctgctttttttgcttgcataattgcagctaacagttgtctattccagaacgcattgttatggaaaatggcaagctgttttgttggtttatggatattgtgtatgataattaccgtcttcgtttgtcgtaaacttgaatgctctaattaaaacagtacggttgtcatgctttgtgtgttttattataaatattatgaattatttggaattgatatgtaatatagataattttgtagtcgggaaatggtttcgggaggtttacgccttccgaatgaaaagggaacccggtgaaaatccgggacagtacccgctgctgtgagtccacaaaaacggacatcgaacttttgccactggtgtaataccgggaaggcacgatgaccgggacgagtcagaagacctgccatgaccggaatgagatttacacctgcgggatatacgggtcgtaatcaaataaggaatagctcatcggccattcaatatttgaagacagacatattcccgttcgtgtaagtccgcacgaacgggaattttttgtgtttgttaataatatgttttacattaaaatgagtgacctatgaaaagaaaattacgctttctggcaggtgcctgtctatttaccgcaaccgccttgttctctggctgtagctcggacgatgactttttgatggacccggttgattccggaacttcgcaaacccgtgctgtgacaaatccggacggtactttaactatcactttcgatgatttcgatcccggcatgttagcaggacctacctcggccggagaaaatctttattcgtaccaagggtatcctcaagtaaccaccatttacgacaatactccggaagaatatctcttcctttcaatgtttaatactgtaggtggaagcacagagtattccagcggcggcatcgcactttccaactggaacatccgctccaatcagtcgggaaataccggagactggtggtattcttatctaaaccaatgttctgtctataacactgcggtggaagcggaaggacagaataaggaagccgggcacagcggttccaatttcggtgtcgtttacggatatgtggatgcttacaatcaggcatggatggctaaaccagaattttatttcaatgttccccggaaattggtcggcctgtggatctgcaacacctcatacacttatggtgtcattacttatggtaatcagttcggttctacgggggtagcgactcctctgaaagagatgaaagggtatttccaagtgaatctggaatgttatgatgcgaatggcggtctgatccgcacttacaaacgtcttttagccgattatcgtaacggccaacaacaggttgatcctatcacgacatgggattattgggaaatcaatgccgaaggggtgcaaagtgtgaaattcaacttcgagggttcggattcgggagcatacggtttgaatactccggcttatatctgtattgatgatatcaccatacaataaaaagaatacaaggatatcccttctgtcgggggtatccctgttatttttctaaaatccacacatcatgcatcgttttcactattttattatttctgcctgtatgctgttcacctcctgcaacaaggatgaagtcattaccgaagaagtaggaggacaacctataatagaacttgacagcgagaccggtatttacacggtcaaggtcgatcacgaattgactatcgccccgacataccagaatgttgaagatgctctttttgcttggacgatagacggtacgctggtttcttcgggtccgtctcttcaacgtacatggaatgaatgcggggatttttatgtcaaactaagagtagacaatgcggaaggctatgccgaagaggaactgaaagtagaagtgaaagaactcacccctccggtcatctcactggcactaccttcgcaggggctaaaagtcgtccggaataccgattacacatttactcccgatattcagcattcggatgtcgaagggttcaaaatcgaatgggtacgggaaggaaaaatcgtttccaccgagaatacttatactttcaatgaaaaagaactcggtgtttatacggtgacaatcaacgcttccaatatagatgggacaacaacgaaagacgtaagcgtagaggtcgtggaaacgatgccctacgttgtcaaattcccgaccccgtcttacctgcaaacatccacggacaggtacacttttgccgaccgtcctgttttcctgcgtccgttgttggagtatttcgacaatccccgttttgagtggagtgtggacggtcaggtcatggaaggagaagtggaacgcatgttcaagttcacgccgtccgcacccggagaatacaccgtctcctgtactgtgtcggaagacacaccgacggaaaaaataagcaggaatatcgacaaagggaaaacggctgtcactgccaccgtaaaagtcgtttgtgtggacaaaaaggaacaagacggcttccgggcctcgggaagttccaagctctggaataaagtctatgaatataccccagctcccggccaatttatcaacgagacgagcacgataggcggtatgaccggcaacgaaacatcccctgaagcggctgtcgcatgggcaacacagcgtttgaaagacaaactgcacgtctctttaggttctttcgggggttatatcatcgtcggcttcgaccacagtattcccaattcgggtaaccaatatgatttctgtgttcaggggaacgcctttgacggcagttccgaaccgggtatcgtatgggtcatgcaagatataaacggaaacggattgccggatgacgagtggtacgaactgaaaggatctgaagcaggcaaggaagaaacaatacagaattttgaagtgacctattaccgtccggaaggcaaaaaaatggatgtccaatggatcagttccgacggtagaaacggctgggtagactatctgtccgcttatcatacacaagactattattatccggcttggatttcggaaaacagttataccctgacaggcacttgtctggccgcccgcaacacccaagattctcaaaccggttattgggataatcagagttatgactgggggtacgtggataatttcggaaacgaccagatagaaggcggcagtacggtggatggaagcggacaaaggaacggtttcaaaatttccaatgccatccatgccgatggaacggaagccaatctgcaatatattgactttatcaaaatacaatgcggtgttctggccaaaagcggctggctgggcgaagtttctacggaggtattttcttttgaggatctaaccaaataataaaaattacaagtatgaaaatttattttcttcccatgctcctatccttgttctttttgggagcgtgtgacaaaaacgatgaaattatacctgaagatgcagatgaaaatttcatcacatcggtcgtgatgaccgtggacgggaaatcgtacacggccgacattacggacaatacagtaacaataaccgttccctatacggtatcgctgaacaacgccgaagtggaattcaagtacacaacttctgcaacaatcatacctgatcctgaaacggtaacggactgggataacgaacgaaccttccgggtgacatcctataacggagatgcccgcgaatatacctataaggtcgtgaaaagcgagatagaatctgacggagatgtggagttgaagaccaccgaggaggtagcttcttttgccgcaaccaaaacaaccgttgtcaaagggaacctgattatcggctctgatgcggaagaggcagaaaaaatcactgacatatctgcattggcatctttgaaagaggttactggcaacattgtcattcgtaacagttacaacggtgcagacttgacagggttggataatatcgtttctgccggaggtttacaggtaggttcgaccgatgtcgcctcgaaagctacggaacttcacatgatttccatgaaagcattggaaacgctctccggagacatatcggtatataacgaccaagtgacgtatgtcctattcgagaaactggcaactattgaaggaagcgtgatgttcaatgcgtcgtcgttacagagttttgagtttccggttctgactactgtaggtcaggatctgaatcttcaaggactcaatgaagagaacacagcagccggttcgattgcgtctttggaaataccggaactgacaagtgtcggaggggtcttgtccgtaaacaatcttgccaagctgacttccatgagcttccttaagctgaaagagaccggtggccttgatttccataccgtccccgtgatgttggaaaccatcaaccttccggaaatcgaaacagtaaacggaagtattattatggaagccaatatggaagctcctcctaccggtagttttgttccccaacgaaatgacgtgcttcaggctttcggtggaatggacaaactgacaacgataaagggacagataaagataaagaatttcacggcactcaaacaacttcccgactggagcaagatcaccacacttggaagcatcacgctggattatcttgaagatgtgagcggaacactgctgttgccgaacgcccgatttgaaaccttcggagaaacagcgccccagattgaaattataaacaaggtgcagctctccaaaattgaaacagccgaagatttgtcaaatgtaaattttgtcatcaccagtctcacgaataataagttccctgaaatcacgttcaagaatatcaaagacttcacttgtaagccaaccaccaacaataccgattataccatatcgacaattcaacatgtatatggaaatctaaatgtgacaggccaaatgcgaagcaatgccaaatttcccgacttggaaatcatagatggatatggatatatccaaatacccatgtttgcttcaatcacaatgccagtcttgaaagaagtgggaggacagttctatttatctggaaattttaccagttgtaacttgcccttactatccaaagtttgttgttcagcttctcctgtatattataaagagggagagggttcgttagcaatatctttacaaagtaaatcgctggatattccggaattgcttcacgtaggaggtgaagggttgttcgttaataaagcaacaggcattacttgtgataaattacagactatagatggtacgctacagataaaaagtgcgacttctctttctcaggaaacactttccatggagaagttggagaccttgcatggggttgtttttgacggtttgacgaaatttaccgactacactttcttcggcaagtttatagaaaacggaatgattacgggggaaagttggagcgtgacgaaatgtgggtataacccaaccttccaaaatatgaaggacaaacaatatacgcagcaggattaaaccttataccttaaccagagtacccgtaatgattcgggtactcttttttatccgaatgacaatgagcagaacaatacaacggatttgcctttttcttttctgcctgccagttttcggcagttgcatgaaatgggattacggagagatggaagatttctctgtatcggcctctggtcttttcattaccaacgaggggaatttccagtacagcaatgccacgctttcctactacgatcccgccacgtgcgaagtggagaatgaagtgttttaccgtgccaacgggttcaagttgggcgatgtggcccagtctatggttatccgggacggtataggctggatcgtggtgaacaactcgcatgtgattttcgccatcgacatcaatactttcaaggaagtgggccgtatcacaggtttcacctcaccccggtatatccattttctgtcggatgagaaagcctatgtgacgcagatatgggactaccgtatcttcatcatcaaccccaagacatacgagattaccggctatatcgaatgtccagacatggacatggaatcgggttccaccgaacaaatggtacaatacggcaagtacgtctatgtgaactgctggtcgtaccagaaccgcatcctgaaaatcgacacggagacggacaaggtcgtggacgaactgaccatcggcatacaacctacttcgctggtcatggacaaatacaacaagatgtggaccatcacggatggcggttacgagggcagcccatacggttacgaggcaccgtctctctatcgtatagacgccgagactttcaccgtagagaaacagttcaagtttaagctgggcgactggccttcggaagtccagctcaacggtacacgggatacactttactggatcaacaacgatatttggcgaatgccggtggaagccgaccgtgttcccgtccggccttttctggagtttcgggacaccaaatactacggccttacggtcaatcccaacaacggggaggtatatgtggccgacgctattgattaccagcaacaaggtatcgtgtatcgctattcgccgcaaggcaagctgatcgatgaattttacgtgggaatcattccgggagctttctgctggaaataacgaggaaggaggacaaaaatgaaaagacatcttattctattgttcgtgggggtaagcctgccctttctgcttgccgcccagcagaaaaattccgtcagcattaccaaaagggtactacgtattccggaggttacggtggtgggcaaacgacctatgaaggatataggcgtgcaacgaacccgtttcgattccatcgccatgaaagagaacatcgccttgtctatggccgatgtgctgacattcaactcatccgtttttgtcaagaactacggacgcgccacgttatccaccgtggctttccggggtacctctccctcgcatacccaagtgacgtggaatggtatgcgcattaacaacccgatgctgggcatgacggatttttccaccatcccttcttactttatcgatgatgcctcgctgctgcacggaacgtcatcggtaaacgaaacgggcggcggcttgggtggtctggtcaggctctccacttctccggccaaccatgaagggttcgggttgcagtacgtgcagggagtggggtcgttcagcacgttcgacgagtttctccgcctgacctacggtgacaaacactggcagtcctccacccgtgtggtgtattcctcttcccccaacgactacaaataccgaaaccgggacaagaaggaaaacatctatgacgaggacaagaacatcatcggttcctattacccgacggaacgcaaccgcagcggggcttataaggatctgcacgtcttgcaggaaatttattataacacgggcgaaggcgacaagttcgggctaaacgcctggtatatcaattccaaccgggaactggcgatgctcagcacggattacgggaacgacatggacttcgagaaccgccaaagggagcagacgtttcgcggcgtcctctcgtgggatcgcgtgcgggagaaatggaaggtcggtgtaaaaggcggctatatacacacatggatggcctatgattacaagcgggacaagggaaacggcgaaatggcttcgatgacccgctcacgcagtaagattaacacgttctacggaagtgcggacggggattatgctccttcagagaaatggctgttcacggccggtgtttccgtacaccagcatttggtggaaagcgcggacaaaaatatcatctcgcaggaaggtaacaaggctgttgtcgggtatgacaagggacgtgtcgagttttccggttccgtttctgcgaaatggcggcctgtcgatcgttttgccgcctcgcttgtccttcgcgaggatatgttcggtacggaatgggccccggttatcccggctttcttcatcgacggggtactgtcgaaaaaaggcaatatcgtggcgaaagcatccatctcccggaactaccgttttcccacgctgaacgacctctattttctgccgggcggtaatcccgacctgaaaagcgagcacggcttcacatacgacgtggggttgtcgttctcggtggggaaagaaaatgtatatgctttgagcggtggtatcaactggttcgattcgcacatcgacgactggatcatctggctacccacaaccaagggattcttctcccccagaaacctcaaaaaggtacatgcttacggggcagagaccaacgcccaccttgatataatgctcggaaaggactggaaactggatatgaacggaactttctcgtggactccctcgatcaacgagagcgaaccgatgagtccggcagaccaatccgtcggcaaacagttgccatacgtgccggagttttccgcaacggtgaccggacgtctgtcatggcggacatggagcctgctttacaaatggtgttattacagccagcgttataccatgtcgagtaatgactataccctgacgggctatctgcccccttacttcatgaataacgtgacactggaaaaacagctctctttccgatgggccgatctgtcgctaaagggcagcatcaacaacctgttcgatgaagaatacctttccgtattgtcccgtcccatgccgggcatcaatttcgagatattcatcggcataacacccaagttcggaaaaaacaaaaatagtaaacgataatctgcatcaatatgaacgcattaaagaatttaagcctgattttgttgctttctctggcatttacaggctgccacaacaaaagctcaaaaatcaatgatttcaacctgctgctttatgctcccgaatatgcctccggcttcgacatcaaaggggcgggcgggaaggaaagcgtactgataaccgtcaggaatccctggcagggagcggacagtgtaaccacatggctgtttatcgtccgcaacggtgaagaggttcccgaagggtttgcaggacaggtactcaaaggagacgccaaacgcatcgtggcgatgtcttccactcatatcgccatgcttgacgcaatcggtgaagtccggtgtataaccggcgtttcgggaatcgactacatttccaacccagacatccaagcccgccgcgacagtattggcgatgtcggctatgaagggaacatcaactacgagttgctgctctcgctcgatcccgacctcgttctgctctatggggtgaacggcgcaagcgcaatggaaagcaaactcgaagaactcgacataccgttcatgtatgtcggcgattatcttgaagagtcgcctctcggcaaggccgaatggatggtagtgctttcagaagtcacaggaaaacgtgagaagggtgaaaaagcctttgccgcaatcccggtcaaatacaacgccttgaaaaagaaagtggccgacagtaccctcggcactccttcggttatgcttaatgttccctatggcgactcgtggttcatgccttcaacccaaagttatgtagcccgcttgattactgatgcgggaggccgctatatctaccagaagaacacgggaaacgcttctatccccattgacttagaagaagcatatctgctcgcgtcggatgcggacatgtggctgaacgtgggaatggcgaactcccttgacgacttgaaggcatcatgtccgaaattcaccgatacccgatgtttcaaaaatggagaggtgtataacaacaacgcccgtaccaacacagccgggggtaacgactattacgagtctgccgtcgtgaatcctgacatcgtgctccgcgacctcgtgaagatattccatcctgaactggtgcaggaagagtgtgtgtattacaagcaactgaaatagatgcgttcccgttcgactatattattctccatattgattacgctcacggtcggtctttttttactggacttggccgtgggagctgtcaacattccgatccgcgatgtatgggcagcactgaccgggggaaattgttcccgtgccacggaaaaaatcgtactcaacatacgcctcataaaagctatagtggcactgttggccggggctgccttatcggtcagcggtcttcagatgcagaccctcttccgtaatcctcttgccggtccctatgtccttggcatcagttccggtgcaagtctcggtgtggcacttgtggtacttgccgggatcggttcatcaataggcattgccggagcagcgtgggtgggtgcggctgtcgtgttgctcgtgataactgccgtcggacagcgaataaaagacatcatggtaatcctgattctgggcatgatgttctcatcgggcgtaggtgctgtcgtgcagatattgcagtacctcagcaaagaggaatcgctgaaagcctttgtcatttggacgatgggggctttgggtgacgtcacctccggacaacttctgattcttgttccatcggtgtttgccggactgctgttggcggtactgaccatcaaaccgcttaacctcctgctgttcggagaggaatatgccgtaacaatgggactgaatattcggcgttcacgcagcctgttgtttctctcgacaacgctgctcgccggaacgataaccgctttttgcggtccgataggtttcataggtctcgctatgcctcatgtcacaagaatgcttttccaaaatagcgatcatcatgtccttctgcccggaacaattctttcgggatcatcgatattgcttctttgcgacatcatttctaaaatattcaccttgccgatcaacgccattacagctctattgggaatcccaatcgtcgtatgggtggttttacgcaacaaatccatcaccgcatgatagaattacagcatttttccataggttacaaagaaaactcgttgctccacgaggtaaatgccacgataaaaaaaggtcaactgacagcccttatcggaagaaacgggacaggaaaatcgacgttgctccgcgccatagccggtctgaaccggtgttattccggaaaaatcattctcgacgggcacgacatcgcctgcatgaaaaccgaagatatggcaaaaacgctggctgtcgtcacgaccgagcgcacgcgcatcgccaacctgcggtgcaaggatgtcgtagccataggccgtgctccttataccaactggataggtaggatgcaagaaacagataaggagatagtcatgcaatcgctcatttcggtgggaatggaggcttatgcaaaccgcacgatggataaaatgtcggatggcgaatgccagcgtgtgatgattgctcgtgcattggcacaggatactcctatcattctccttgatgaaccgacttcctttcttgacatgcctaatcgctacgaacttgtggcgttgcttcgtaggcttgtccacgacgagaaaaaatgtatcatgttctcgacacatgaacttgacatcgcgttgtccatgtgcgattcgatagcattgttagataccccgaatttaagttgcttgaccgcgtctgaaatgcagaaaagcggatacattgacagacttttccaaaatgaaaacatccgtttcgactccttatgcggtacaatgattttgaaacaatgagtatatacactgtagaaaattttacttcagacatcactgttgaaggatatatcgccgaattccgtgacgaaccacattttcttgaactttgcaaacaatgtaccaattacggtaaaagttgggggtgtcctccatttgattttgatacggaatcgtttctccgacaatacaagtatgcacatcttatggcaacgaagataatccctgaagacaaagatattccgattgaatatacacaaaaactcattttaccggaacggatacgaatcgagagcgaattattggatatggaacggaaatatggagggcgttcatttgcctatataggtaaatgtcttcactgctcagataacgagtgtacgcgtaactgcggcacaccatgccgacacccggaaaaagtgcgtccgtcactcgaagccttcggatttgacatagccaaaacgctttctgaactttttaacatcgaacttctttggggaaaggatggcaaattacctgaatatcttgttctcgtaagcggattttttcataatgaatacgaactttgcaacatagcatactaatgattcggacatgaaataaacagacaaactaaccacattcggttcaatctgttttgtgatttcaaatgaattatagttagatatgtaaaaagcgacgctggagcttgaaataagtaacggtttatcggtgtattctccgttaaaccgtcctgttttcgttaaacgaaaacacaacttgctgtcccctaatggggacaacattctccaataggaattgtgtatcagcccattgtacggctattctcctgtgattttcgggtcatttccatcaggcatttgccggctgctctccccataaaaaggtggctgtctctcctgaatcatgtgacttacgcccataattcaggaataagggagacgtatgtactggaaatctgccctttccataccctattctccattaatggattgttatttttacacttctgcaaatggagaatgggcagtgaatcgtatatgccttatggctttccttcactgtctcctttgacggattgttacttttacacttctacaaatggagaatgggcagtgaaccgtatatgctttatggccttccttcactgtctcctttgacggattgttacttctacacttctgcaaatggagaatgggcatgtaaccgtgtatgccttatggttttccttcattgtctccattaatggattgtcacttctacacttctgcaaatggagaatgggcagtgaatcgtatatgccttatggctttccttcactgtctcctttgacggattgttacttttacacttctacaaatggagaatgggcagtgaaccgtatatgctttatggctttccttcactgtctcctttgacggattgttacttctacacttctgcaaatggagaatgggcatgtaaccgtgtatgccttatggttttccttcattgtctccattaatggattgtcacttctacacttctgcaaatggagaacgtgcatgtagccgtgtacgccttatgttttttcttccttgtctccattaacggattgatatttttacacttccacagaccgataattcaagaatccgtatcaggacggatgcatgctcccacacctgcccataaggatttgaaaggggcggtggacaaggaacggaatcccgccgcttttccacgccgctacggacagtaggattctgacgtcactcctgcatgggaagaaccatccggatggaaccatatgttcgtccccccgtcatgtgtatcatgacaatccccgactttggatgactataagtgacaggtggttccgtcctgtcctcttctttttttattttgtattccgaaacaatgccagttgtgtaatttaataatttaagattttaagacaatggattcagaaaaggaaaagaaccggctttccgatatcgttctcgagagggtcggactcacgggaaaccttctgtcagctcccgtttccccatccccggaaccggcggtggatatgccgggtcatgaaaggcaggtccgtgcagggaaagtgacagccccggaagaatacaagaggaggtttctggttcccgctcccaagtctgtggagtggaagaccgcgtatattgacgggaggctgcaccgccggatcgccatgctggtcagggccgccggttgcggcagcatctccgggtttatcatccggctgctggagctccatatggaggaacatagggaggatatcgccgccctgctcggtgaggtctaccgtccctgggatgaggacgggcagccgggagaaccggcccgccgataaaatgttgtcattgtccaagaagatatatcatgacaggaaagaacgtaaaagaccggatgggtcccggcgggatggacgcggaccgcatccgtgagatcatgggggaagcacctgcctgtccccggaagggacgtggaacgtccggtaacgacataatgcgtcccgcaaggaaaagcggccccatgcagccgtccgtctatggggaggaatacctgcatggcattgcgggcgtgcagcgccggtcactgcatattcctgccgccctgcaccggaaactgtccatcctggcgggagcctcgagaaatggaacggtcacgctggaggggttcatcaaccaccttgtatcgcggcatctggaagaatacagggaaacggtggagatgattctggaagagtccctgcccgaccggtcataatagtgtttaacatttaatgcaagaagtatgatgaaaaaagaaaaagagttgttggttgccgtcgccagccagaagggtggcgtgggaaaatccgtctttacggtactgctggccagtgtgctgcattaccgcaaaggcctgcgtgtggcggttgtggactgtgactacccgcagcacagcatcgccctgatgcgtgagagggacatggagagtgtcatgaaaaatgacgacctgaaggtgagcctttaccggcagcacgagagaatccggaagcctgcctatccggtcatcaaaagcgatccggaaaaggcggtggaggacctgcatcgttatatggacgaaaagggggaaactttcgatatcgtgcttttcgaccttcccggaacgctccgcagcgagggggtggtctatactgttgccgcgatggactacattttcgtcccgctcaaggcggacaacatcgtcatgcagagttccctgcagtttaccaaggctctggaagaggagctggtcgccaggaagaactgcaacctgaaagggacctggctgttctggaacatggtggacaggagggggcggaaggacctgtatgacgcctggaaccgggtcatcgacaagatggggctgcggctgctgtcctcacacattccgaacaccctccgctacaacagggaggcggaccctgtctgcaagggtgtcttccgttccacgctgtttccacccgatccccatcaggagaaaggctccggccttcctgaactggtggaggagatatgccgtaccatcggcctggaggaacccgataccgaccggtagcggatgtcagggtatagacaccttaaataaggacttttagcctaagataaagtaagctaatagcatgataataaagctcttataattacgatttctcctatgaaagcattaccttagtagtgtaataataaaggaggtaacaagttatgaacgagcaaattagaagcattttagcacaagagacaacaaagacaagcaagatccggcagctgtatcttttaggtgttccccgcgcggaaatcgcaagaatggtaaccaacggcaattacggttttgtggtgaatgccctgcgccggatgaatgagtgtggggacggtccgaatatccatccgtcgacagctgcgttggactatgctttcaaccgcaagttcggtatcgagatcgaggcctacaactgttcccgtgaacggcttgcacgcgagctcaaggaagccggcatcgaggttacggtggaaggttataaccataccacccgtccgcattggaagctcgtgacggacagcagcctgagcggcaacgacaccttcgagctgctcagtccgatcctggtcggtgaaaccggactgcgggaactggagaaggtctgctgggtgcttgacttgtgtgacgtgaaagtgaacgagagctgcggtcttcacgtgtatatcgatgccaccggtttcaacatggagacctggcgtaacctggctttgagctacaagcatctggaaccggtcatcgaccggttcatgccggcctcccgtagggacaaccgctattgccgcggactggggcacgtctctgatgagatgatacgttccgcccggactgtggacgagttgaaaggaaggatcggcgaccgttaccataaggtgaacctcgaggcctactcacggcacaagacggtcgagttccgccagcattcgggaacgaccaacttcacaaaaatgcgtaactgggtgctgtttctccacaaattggttacctttgccacaagggaacatgtgcctgcggccaccacgctcagtgacatccccttcctggacagtgagcagaaactatattataaattgaggactaaaaaattatcggcatgaacaagcatatgtatattttggcggacggcggcaggattgccgcttccggcccttccgagtttgtacgcctcctgcgtgagggcagctggtttgacagcgagtgcaccgacgaggagtacatggtgaatttctccgggcggtacagggaactgcacggggtgacggtgaggaccgacacgccggagcatttcatggacgacctgaaaaagtacggttacatcaagggctgagaggcccgttcctttattgttacgttccctgccggttcattcatctccggtggggatttttttcttttttcacggtatctgatctccgccgtatcctgttttccggaggctggtttcacgacctccttcctcaatcatttttttctcttttcatactgctatcaacggattgtcgtacttttacacacaatcccggcaatatcgggaagaatcccgggctctcgccggactgccatttgtcatatcttttgccggcattgactatttatgtctatatatgactataactgacaaggtattccctcatacatttactctttttttctttgcggcgtaggacgacaatccgccaccgggaacgtccgcctgaccaaacacccggttatcacatggaattaatgtataaatcagaagttatggttatggacagcattgaaaggaaccccaaaatccgtatcatatcgacgggaagaagatgccggatatacgttgctgctaaaggttcatatttgaaccgcatttccggggaccggaaagaggtggcgcccacaaggacttttcatcaccggtcggaaagtaaaaaggcgataacggagaaacggtaaaaaatatattgaactccttcttcaaacagctccggagggggagtcggaaaccacgacacccagccggaagtgcctttggaaagtattttgaactgtatttcaataatttgagtttctgacaggaagctatttaaaatggaaagaaaaatggactataataagaaaactgaatatggttaacgataattagtatatttatgcagttgtcgtgcatggaaagctcgtcggggctgactgctcagcccctattcttatggattacgcaagcgaattttgataatttctcgaaaaaaaagcatccgtcctaattacagcgaacataatcgtaactaatttcgctctaactgcattcagaaccgacatcttattttttccctcttcgacctttctgtcataatatttcttcaatggactatttttcacttgtgaaacagatagtgccgccatatgtagcaaatgcttgatgcttttgtcagccctattagatactctatttttagaacgttggctacttcctgacacatagacgaacggaacaactcctgcatgacagcaaaacttcctgggatcagtaaaagaagtgaaagcatctgtttccatgatcatcttcagtgcaacacgttccccaactccatccacagacatgagtaaatccatttgatgagcaatgacaggtgcttgatttataagttcttttatttcaaggtctatttgtgctatgtaatccgtaaatgtattgataatcccttcaactctattgcatttagcaatatatattgagtgttccatatagtctacctgatcttttagctgggattgatatttagccctatctgcaacaagcatactgcgttctgttgataagtttttgagtttttgtattataagctctgatgcggtatacggttgtaggcaatcattatatctttctgcatacattgctattcggcaggcatctattttatcatttttgccacgaggtattccatgacaatattttattttagctgcatcttccaaacataagtagactcctatactttttgttgcacagaccaaaggataggtatattgccctgtatgttccgcacagacaaccaaactgtcctcagagaggaaaaatttctcaaacgttcttgttaaccaagatttaatagaggatagatcattaggaataacatcataaaggatgtccttaccgttactccttaaacataaatccaattttttcttactcacatcaactcctaaataaaaaactttcatacttttgtttttgaacattaaacaaaaaagaaaggacctgaacttgacctaataatcttaaacaggtttactgaaattcttatatgggtttgagttcaaggaaggagcaaaaggaccgaatagggacttagacttgacttctattgccgctgatggttttccttttgctttcctttcaatatcaattcaaagataaatattttgatgctgcaaatctaaggttgccgcatggcgttccctccgcagatgagtatttacggtttctcggacttgaacccatcgacatacggttttccttgcgtgaccacagcgaaggcttgccttataagtttgttggcgacagcaacgaccgccaccttgcctggcttgccgttagaccgcaaacggtcgaaacaagccttgcactcggcattacacctgagtgacgagaaagccgccacatagagctggcttctgaggtttgaatccccgttctggttgatgtgacctttgacattgactgacgtaccgaactgttggtaaataggtgacaggcccagataacgggtcagttgcttggcattatcaaaataggtgaacccgcctgtggccacgataagcgcggctgccagtgtaacaccgatgcctttgatggaggtgagcaagtccatctgtttcctgtactcgccttacgccaaggaagtgatattctcttccattgccttgatttgcttctcgaggaaagcaatcgtcttttcgatggttttcttgcattcagggtcaaaagaagaaagaactccatcgagcctttaaggttgcgtgttgccacaagttgcttctttagctggcgtagtaccgttcgtttctgcttcagtacgaggattgagtcactgcggagcttataaggatccggctgcatcctctccccgtacagggctatcagacgggcatctatctcgtccgtcttggtgacggagagcatggcacgggcgaagttctttatcttcagcggattctcaaggctgacggttatccctgcttcggaaagcagatagacgagcaacgcactgtaattgcctgtggcttctaatactcaatggtgctctgctactgaaatggtttggatgaactcatggacacccttaaccgtggttcttgaatgtttttgtcctgccggtcttggcggacgaataagcgacaacaaaggtcgccttgctgacatcgattccaacgtaggtcatagtctgaaactttaattaaacaacatcactacatcgtgagccatcattacgaatgcgggggctcaaaagcccattgaactatccggtttctgatgtaagagtgtgggggctaaacatttttcacggtctttacgactaatggaaattgaaagttcattaaaaacgaaatggcaaagaattaaatgtaaaatcaacgctctcttaggtttctatagaaaaactatccatattatatatctataaacatttataattagacatatgatatacggatacattagagtaagcagtgataagcagacagtagaaaaccaacgttttgaaatcaagaatttctgcgacaatcaaaacataaaaattgatggttggatagaggaaaccattagtggaacaaaagcctataacaaacgtgaactcggaaaattgctcaataaggtacagaaagatgatttgattatctgcgctgaattgtccagattgggtcgtaatctctttatgataatggaaattctgaatatttgcatgagcaaggaatgtagggtttggactatcaaagacaactataagttaggagaggacattcaaagtaaagtgttggcttttgcttttggactgtcagcagagattgaacgtaaccttattagccaacgaacaaaagaagccttagcacgaaagaaaatagaaggggtaatattaggacgtcctaaagggaaaaaaagtgctccagagaagtacaaactccacgataagaggattctcatacaagaactattgaaagctgaagtttcacaacgcaaaatcgctaaaatttgtaaagtggatagaaatacgctcgctcgatttattaagacttttatggtagaagcataaggagcgatttcgtgcagcaacaaggcgtgaagtgtaactttgcagattctatcccgtgggtgatattgtctcccattgaacaaagtatcaggcgtaagattgaatctattggtacaccactcaaagattgggatataaacatttatcgtggagtccttaccgggtataacgatgcgtttatcatatctaccgaaaagcgtgatgagatattggcgaattgccagacagaaggcgagcgtgttcggacggctgaacttatacgaccgattcttcgtggcagggatatcaagagatatgaatatgaatgggcggacttgtggattatagccacatttccttcgcggcattatgatatagaaagttatcctgcggtgaaaaattatcttctgtcaattggcatagagcgtttagaacaaacaggagaaactcatattgttaatggcaaaaaaataaaagcccgaaagaaaactagtaacgagtggtttgaaacacaagatagcatcagttattgggaggatttttctaagccaaaaatcatatggggagaaatatctgataaatcaaaatttgctttcgactttttgggagaatatataccagaagcaacttctttttacatgaaaggcgagtgtattgaataccttttgtctgctttaaattcgtccgtgtctgaatggttgttttctaaagtagggacaactacaggagtagggactattagatggaaaaagtataccatagaacagcttattgttgctaagctatctactgaacaactaaatactcatcttgctgctttcaatgatttgaaagtaggcaagatgagcattacggattttgaatgttttagcaataagttgatgtatgatgtttataaacttacctcagatgaaattcaatatattgaaaaccagcaaattgtctaaatagactttcggagtgaagaaacaaatgaatgtagaaaattagtttcttcactcgtgaatccatatatcattgaaaccaaaccctctattttagagtcaataaatggtagattgatatttttatttattatactgtttgcaagttctgctaattcaatgagttctattttattggcatcataaaaaggtatagggaaagtcgctatattttgacctccaacttgaacatctccaacgccagttttattcatattagtcacatagctataccatgttatagcttgtgaattcaatactgccaacagataatccaaatgatcgcctgtcataatataacaggcattgttcattacataattgttggcatcatatgcaaaagccatttggtttccgattattttccatacaatttttggcttagaaaaatcctccgattcttcgtggcagagatataaagaggtatggatatgactgggcagggcaatggctaatatatatcccttggcatttcccataccaatttgatgaatctataactggtgcttctgaaaaggcagaaaaagcgtttaaagaacaatatcctgctgtatataaccatatgttggaatataaagaaccactttctaaacgaaacaaagcagagacaggaattcgatatgagtggtatgctatgcaacgttggggggccaagtattgggtcgtataagttcagccgtccgaacacgttcatcttctgtttgacaattcgctagtatctcatcacgcttttcggtagaaatgataaaagcatcattgaaaccagtttttatcccatagttgatttggatgttccaatccttcaagggtattcccacagactcaatcttctgcttgatgctctgttcaatgggagacaatatcacccatgggatagaatctgcaaagttacacttcacgccttgttgctgcacgaaatcgctcaaattattcaagccattcgaatcttgtaccaaacaagcttgtgtgttaaaaatatttgctgctttttgagataaaagaatatttgcttctaccgttattgcatcgaatatttttatacctgcaaaatctaccaacataataggattggtcttgcttgcgaaataacctcgcaaggcttcaccataccctgcacgcatccatttattagacgtgatatagcaaagaaaaccattgggagtaagcaggttcatacccaactcatagaagaggcagtaaatatcaccagtgcgtgcataagttatgtaacccatgcattctaatacatcggcactcttacccatagattgtaactgaatgtaaggtggattgccaatgatacagtcaaatcccaagaagttgccttcggcatcgagtacttctggaaactctatacgccattcgaatgcaccaagataaattttgttggagcgtatttcctcaaatatattttctaaagtcgcaatttctttctttaaatcggcaatgcgcttgtccgacgctttcttttccttttttgtcggttcaaacagttgaggcgcttgtaagtttgccaactcagagcggcgtttgttcaatctaaccaatcgtgcatcccggcggttgatctctgttttcagtttcgacttgatttctgttataaacgtttccaaatcctgcttttcgcttttactttgggcatttttatatttagctacagcctccttatattggctgatgctgatactagactctcgcagtacggtctgaatactgtctgtcaaagcgaatcggtgaagcaaagaatttccacatttgatgttaatgtcgatatttggtaaggtttctaaataagtgtaattactttcagccgtatagtaagcattcttcaacaattcaatccacagtcgtaggcggcaaatcttcacagagttggggttaatatcaacgccaaataaacagttctcaatgatttgacgcttctccttgaaaagagtttcctgcatgcggcgactttccgcattgagtgggttgtaagcaaataaattaccttcggtatcggtaacaatcagctcgtcattttcaatggcaagttgatagtccgctttgcggatacgcttaccggtagcatctaccaaaatacctaattcgtatttcaagagtatcagttcattgagagcagacacaagaaagtgacccgaaccaacagctggatcacacagtcgcaaactgttaattagttcattagcttcgactatattgtcaatatggttgtatagttctatacgggtggtacaattccagccataataaccattaaacttttgcaacacggtcttggtgattgcttcacggcacatgaacatagtgataaagcctggagtgaatactgaaccatccttgtgaccatttattttctcgaatataagccctaaaacagaagcattgatgagtgttttagcctcttcttgcacttcttcactgccttcgctcgcaaagttataagcgtcgagaaaagcaaacaaatattgcagggtgggtaatgcgttgacttgtagattgcgttttttatttcgtaatacgctactcgccaagacaggaagtaccgtacgttgtgaaaggctgtttatcttaattgttttactttccaaatctgtcacctcgaaaagagaactgttaagatagggaacgtaagcaaaatcacgcataatggagtgtgtgcggctgcccatgtcacgtgcaagcacttggaaaaagagtgtgttgagatcatcatagtcatgaatcttagttattgaaagaaatttatagattgcatctccattgtggtatttcaacatctgagcctccaacagtttcaagaaaaggatacgattcatccaagtaatacacaattccattgcaacattgaataaccgttcctcataatcattcccatacaaactaccatttatgtgacgcaaacaatcttctgcatccagttggttaatagtattctctagtaatgaagcctcgtcacgccgttccacagctttgcgtacaatcacggttttattattctctttgcgttcctcaataccaataatgtgtagcagctcagtgtagaatccacggttgagcgaattgctgtcattttggaacgatagcttcaaaagatgtgtatcgctgaatatcttataaagttcgataagtttgcgtgaagcgctaccgtctgttctatcaagcaggtgttgatagtcttgtaagttgaagtaagtgtattcaaggctatctttcacctcctcaatataggttgttgcaatttcagtatagaagaaatcggttttgttactggttttgcgtccatccacaaagtcttgaaactcacgacgtaattgtttgttctgatagaatttgcgttcaaactcatgggcatcaaaaataaagaattcatgaatattagtagcgatgagatatttaatatcattgttcttcttattgacacgttctttaagatagtatagcaataattcctgcaaagccttacgattaagattgtcattagaaatcatctcacctttgttggtggtactctttacttcaatcaataaccctatattggacttgatagttttatccaatcggatagccaaatcaatatcttcttcgggagccatgtagtatggcttgtagaacgtttcactcagaaaattacgtaaatgttctttttgcgtgtgttctctttgcccatccacaatattgtctctcaatgtgcgaagggcatttttgaataagtcaaaatctgttgtttcaatcgcaacctgtctatatgctttgttcaaaacttgattcggtttgagtagtcccataatgtttggtaaatgagttaataaaatacaaaggtagtctaaaaacttgataataaagaatgaacgtattggtttaacgaaagtttgttctactgccagccattatcaacaaacaatagcagcagtagatttgacatgattctacttattatattgtaatagccagccaaagtaatcttttcacatccggatctatcacaggttggataagttgttaacctgaaggtaaccgacctgatggtataggaacaggaagaagtctgtaatcatggcatttacccggatagagaagccacattttttattgccggacttccggcattgcctcatccatgtgtgaaaaggagttttttctttcaccacaacgttcctttcacatacccaaagggggtagtggctccagacctgcttcggctttctttttccttcccatatgacaaaaaccgactatccatgactattcctgccagtgtgccggtcgtgcttgcctctcatggtttcttcccttatattcgcactgatatttaaacgagttgaaaatatggaaatatgctacatcgaggccggtgtccttgagaggatgctggcacgcacacccgtatttctttcttaccacagctgtggtaagaaagaaatacgggtgtggaaagattagttcttagggaaaaataaggtggtacatcgctgtttgtatcctaattcttagctaccatctatacgccatacagcgacaatcagtagaagcctttatcaagtccacttctgtgccctacccaaagaacgcacagcggcagcaaactcttcccgaggaatgatagccttattacgtgtcttcaaacgattattataaacggtctgaggtgaataatgcaagaattcggcaatcttcacactatcagtgatacctaaacgcaccaaagcataaatgcgcaattccgtattcagcaactcaccatcttttagcacaatctgctcgtcaggatggagcaaggcattgaagtcacttacaaaatccggataaatgtgcaagaagatagcatcaaagttatgatagaactctttcagctcattctgtgccatagaatgagtatcggttaatgctttcacatcctccaactgatttgccttaagcttacgattgatatttttccgatactcatccagcttgctgatataattggaacaaatggaaaaaacataacctatgtattcctccttcacatagttggattcacgaagctgattattggtatctctcagctgttcattcaaagaagtaagctgtacattcgtttctgccacttgtccgtgcattttcgaaagttcttccacatgcttattcaagcggttgtttgcctcattcagctgttggcgcgactgcttcaaccgcttcatctgcttatatatatacagaaaagcaaacaaggatatcaaggacaagacactgaccaataccaaatacatacgtaaccgcgcttcttgcttctgattacgttcctgataaatctgatgaatggtgtcctgcaccgcagagatgcctactactctcacccggttccgatatgccaaggcattctgcaagcagtaactcatgtagacataggcatggtcaatatcacccaaactaaaaagcacccccgccagctcttccagcgaagcaatatctttattggagatacgtacatcggccatagcagaatatatcaggtaagtcagataattttcttgctcatcggactcgcgataaaagcaagccagcacgtaagcattcatggcatcacgccgagtatcgaatgcagaattaaagattcccttctgcaaacgctccttaaaaacatacatactgtccgtaccttgcactacctgccccttataccacaagaacaagggatgttcaggggtaagaaccatattcaaggagtctttgtaaacacgttccaactgtgcataatgttcatgcaaagtggccatttcactaccggtatactgattgaaatgcgaatacagatacagcatttgtccataatagtccactaacaattctttggggagcgaaccgcctgaaactccgcgcaattcatcctgggcttctttcaacaaaccggtggcagccaacagaaaagacttttttatcttccactccatctgccggtatttatcattctgcctataaactatatccaaattatctaccacataattcattgcagaatcggcattatagacacaatactcatcataaagatttttattcagccaatatctctcctccaaagtacgcacatccttttgaagcttgtgcaactgagcaatcttcgcctctttaagcataacaaacgtgtttttctgcgcaatcagagagtcaaggcgtaccagtagttcttttatcttttcactgtaaggtgccgcattcaggaaagtacaccccaccagcaaaaacagcaaagctatgatttttcttttcatttctattatttacataaagcagagagcacaaagataaattaatctatctaaagataagctacttctaccctaaaaaagtacactaaaattaagagctatttcgatcgtttgaagtaataacacagtatgtccaaacctacttccatagtagcaaacctttactttacccactaaccacaaacattataatacactgattttatgatatttaaattttatacagacttacttccacacattacccacctatcagacaaatagggttgtccactatctttgcaaacagaaaggaaagtgtactatggaaaaacaactaatccctattagaacatacttttctaaataaatcaaatcttttaataaaagtactatgagaatgattacaagaaatcttcttacgcggagttacaagctccttctgacattactcgtactgctaatgtcaacaaatgcatttgcccaacgattgacagctacgggtaaagtagtagataccgcaggcctggaggtcatcggcgcatctgtattggaaaagggaacaacaaacggtgttgtcaccaatctagacggagagttttccctaagtgtagaacaaaatgccacactggtaatatctttcatcggctataaaacgatggaggtaaaagcaaccaccaacatgaatgtcacattgcaggaagacaacgaactgctggacgaagtggtagtcatcggctatggaagtgtaaaacgcaaagacgtaaccactgccgtatctacggtttctacaaaggatttggatcagcgccccattgtatcggccgcccaagccctacaaggcaaagcagccggtgtgtcggttatgcagcccagcggcgaaccgggcggtggtatgagtatccgtgtacgtggtaccacctcattcaatggtagcaacgacccgctctacgtagtggatggtgtacctgtagacaatatcaacttcttatcacccaatgatatcgaaagcctctctatcttaaaggacgcttcatcggcagccatctatggttcacgtgcagccaacggtgtagtactaattacgaccaaagccggagcagaaggcaatgccaaagtagcactgaacgtacaatatggtatgacgaaagtggccaaaagcatggaggctttgaatacagagcaataccgtgaattacagaaagagattggcgccgtcaatcccgctgaccttgaaggtttaacagaccaaacagactggtttgacgaggtttacaaaaccggacaaactcagaactatcaagtgtccgtgtctaacggaaacgaaaagatgaaatacttcctctctgccggttatctggatgaaaaaggaattttggaaggtacgtacttcaaacgatacagcttccgtgccaatatcgacaaccaaatacgcagttggctgaatgtaagtgccaatatctcctactccgataacatcggaaacaccggcatcatttccggaacaggtgccaaccgtggaggtgtagtcctttcagttatcaatacaccgacctatgctcctatttgggaccctgaaaagccgaatcaatacaataagaacttctatggggtaaatatcatgaacccgatggaaaacctagcccgccagaaaaacaacaaaaacaaggaaaaccgcctcatcgcatccggagccgctaccatcagcttcctgcccaacctgaagttgaaatcatctgtagcactggaccgccgcaacggtgtaagcactacatttctcgatccaatatcaactaccgacggacgcaacagtttcggaacagcctctgacaaccgaaacatgaataccgtattggttttcgataatgtattgacttacaacaccaacatcaagaaacatggcatcgacgtcatggcaggttcttcctacaccaaatcagactataccaacagctatattaatggttcacacttccgggacgataaaatacacactctgaatgccgccaataaaatttcatgggacggtaccggatcaggagcctcacagtgggctatctcttcctattttgcccgtgtgtcctacaattatgacagcaagtacatgcttaccatgaacatgcgtgccgacggttcatccaagctgcatcccgaccatcgctggggcattttcccctccttctcggctgcctggcgtatttcgtcagagaaattcatgaaagacattacttggattgatgacttgaagcttcgcggcggctggggacagaccggtaaccaaagcggcataggtgattactcatatctgcaacgctacaacatcaaccgcataccgtggtttgaagaaggcaacgaccatgcagttcccggtatcagccaagccaaccttagaacaagtgacctgaaatgggaaaccaccagccaaaccaacatcggtcttgacttaactgtgctgaacaatagactgaccttcagcatggattactattacaagaagacaacagacatgttgatgaatgtaagtctgcctgcaggtgcagcagcaactaccagcatcacccgtaatgaaggcgagatgaccaataaaggatttgaattctcactcaattctcacaacctgaccggcgaattctcttgggacacagacttcaacatatctttcaacaagaacaagctgactaagctatcattacaaaaagtctatacagcagcaagcagtgccgaggtagtaaaggaaaacatcgtacgcaatgaaccgggacgtcctttgggtggcttctacggctacatcagtgacggtgtagatcccgaaaccggtaacctgatttatcgcgacctcaacgaagacggcaaaatttccacttctgaccgtacctatatcggcgatccgaatcccgacttcatctacggattgacgaacacttttacttggaaagaccttagtctgagcatcttcattcaaggaagctacggaaacgacatcttcaatgtgtcccgcatggaaaccgaaggtatgtatgacggtaaaaaccaatcaacagaagttttgaaacgatggaggattcccggacagattaccagtgttccgagagccaacttcaacatcaagaactccacttactttgtagaagatggcagttatctgcgtgtcaaagacatctcactctcttacaacatccgttgccgccagtttaagaaatggggtatcagccgcgtacaaccctacttcactgcaagcaatttgctaacctggaccagttattccggtatggaccctgaagtaaaccaatatggcaacagcggttccgtacaaggtatcgactatggaacctatccacagagtaaagcattcgttttcggtatcaatgttgaattctaaaaaaaagaagaaataacttatgaaatcaaagcatatatataaaagtatagcttgcggtgtactgttggcactaaccgcaacctcatgtgatctggactataatccggtagacagctactcggatgtaacggaaggagtggacaaaacagatgaaaaacctattttcaacagtgtgcaagatgtggaaacctcaatggtaacccttcataaaaaattccgcgaccagcaggagcactggtatgtcgacaaactgcttatcggtgacgcccactccgacaatgcatacgccggaacaacgggtgcagaagtagtaccttatgaaaccaattccattgaaggatctaattccgtactaaaacgtgactgggaccgttttctgggtgatattgccgaagccaaccgtatcatcgtaggctgtgagcaactcaaggccctcagcgacagtgaacgtggcaaatatcaatcacaagccaagatattccgtgccatggtaatgttcgatatggtacgtttatgggggaatttccctgtcatcactaccgtgggtggtgacatcaccgaagacaacgtagaagagatgtacccgacctactttcctccacagaatacagctgaagaggcttatgcccaaatagaaaaagacttgactgaagctgtggaaaaccccaacacaccgacaaacgatgcatccgacaagagcatacttaccaaatcggtggcacgtgccatgcttgccaaagtctatgcagaaaagcctctgcgcgattatgcaaaagttatcaaatatgccgacgaattggctgccgacggcttcgaccttgtagaagacttcagcgacctttgggcttatgatacagaaaaaaaagactgccgggtacgcaatactaaagaagctattctcgaagctcattttcctcctggttcagggaactggtgtacgtggatgtttggccgcaacttaagcaactgggatgaaagctttacctgggccaaatggattactccttcccgcgaccttatccgcctctatgaggagcaaggagacacgaaacgctacaatgagtctgttgtatggtatgagtgcggatggagcaactattatccggcagaccattatgctttcatgtacaaatgccgctctgctttcaacagtatcatttatctgagatatgccgacatcctacttcttaaggctgaagccaaaattatgggagaaactcccgacttgaacggtgcagccgacattattgaccgcatccgtaaccgtgccggactgggtaaacttccacaaagcacccgtagcagtaaagaagcattgctccaagcttatatggacgaacgccgtatggaacttgcttttgagggacaacgctggtacgacctttgccgcctcaataaggtagaagaagtgatgaacgccgtttatgccaaagacagtggccgccttgcacaagagaatttgtttaatgaaaactcttatctactcgcaatccctcagggagccattgaccagaatgagaatttggtacagaatccaggctattaacaataaaaagtaatataaaaatcaatagaatatgaatttgaaaaatatattcactaccgcattaggctgcttcgctgtattggcagcctgcggcaatgataatgacagtgacgtcactcctacaccagaccaacctacagaagaggcaaaagatgttactatctatgtgacgaacaccagccgtacttacgacttgaaaaagtctggactggccttcggcaccggaagcaacatgtcaccttctaccgtgacactcgaccccaccacccgttatcaggaaatggacggttttggcgcagccattactggctctaccagttacaacctgatgcaaatgacacaagagaaccgcacgaagtttctgactgagacattctcggataaagaaggctacggcttcagctatgtacgtattgccatcggttgttccgacttctcattcagtgaatttacttgctgtgacgaaaagggacttgagcactttgcccttccgatggaagacaccaagtatgtaattcctatattgaaggaaattctagcaatcaatcctactgtcaaagtgattgctgctccatggacatgtccgaagtggatgaaagtgaaaagcctggaagaacgtgtaccctttgactcatggaccagcggacacttgaaccccgaatattacagaacgtatggcgaatatttcgtaaaatggatacaagctttcgaaaaggaaggtatcaaaatccacgctgtgactccgcagaacgaaccgctgaaccacggtaactcagcatccttgtttatgggatgggaagaagcccgtgacttcatcaagaccggcctgggtcccgctttcaaagaagccggagttgccacaaagatttatgttttcgaccataactataactacgacaatctggccgatcaaaaaagttaccccaccaagatttatgatgatgcggaagcctcacagtacattgcaggtgctgcctaccacaattatggcggtaaccgttccgaactgctgaacatccataagctttaccccaacaaggaattgcttttcacagaaacatccatcggcacctggaactccggccgcgatttagaagcacgtctgcttaacgatatggaagaaatagcattggggacagccaacaactggtgccgcggtgctattgtgtggaacctgatgttagacagtgacctgggaccggtaagcccttcagacggttcttgcaagacctgctacggtgcagtagatatcgacaatacaaactattctaaaattgtccgcaattcccattattaccttatcggccacatgtcttcagtcgtgaaaccaggtgctgtacgtatcggaacgactggttacactgccaatggggtcacctactcggcctttgaaaacactgacggcacctatgccttcgtattggcaaacaacaatgcagatgccaaacgaattactgtaagtgacggcactcactacttctcctacgaagtaccggctaaagcagtcgtttcttatcgttggaaaaaataagactaacaaattaaacagaagattataatgaaaaactttaaatactatctgatggcattggcaagcatagccatgctgaatgcctgcagcgatgacgatccggttcccggcaacccgacaatggactttcaggcagaaccttcttcagccttgttcggcgacagtctgccttttacaatcaaagcttcggacgcagatgtacctctttctacactgaaagcacagttatacttcagtgacgaaatggtttccgaaactgtaatccgtaccaaagttagcggacaagagtataacgggaaaatatatgttccctatctggcaaacattcccaacggaacagctacactgaagtttatcctgcagaacatcaactttacgattacagaaaaaagctacgacgtggcgctgagtcgtccggacttcccctacctgactctgatttccggagaccaagaataccgcatggaaaaagtcgcagccaatcagtatagtgtgaccagtgaatttgcacaaaaagtgaaaggttacatcaaagctcctaaagtaggcgccaacggcaatgaaatcaatttcggatggagtaacggtgccatcacacaaggtacttccagtgagattactttctccagtctgtcagccgggaagtattccatctccttcaacacgctgacttatgcggccgcccctttcgtgaaattgttactgaacggctctgaaatggaaatggtggatgataaccattacagcatcgacctcaacctgaaacaaggggacaacatcaccgcagatattcccaacttcaaccagtactggatagatcccgacttcttcaaaaagaatgaagacggttcactgaaatttttacccatcgacggaacttaccgtatcattgccaatctggacctaaattatttggaagtattgaaaatgaacggaacaagtaccgatacactgaacgatgacggaaccggtgccctttggattatcggtgatggcatcggtaagccctcagtagcaaccaatgccgtaggttggaccacagagaaagggctctgcatgtcacagattgaagcaaagaaatatcaggtgacggtagtagcgggagagcaaatcaaatcagatgacatcaacttcaagttcttccaccagcaaggttggggaggtgaatataaaaacgatgccttgtctaccaccagtgacctagtatttataggtgacggtaccaatggacgtgatgccggcaacttgggactcgtaaaaggcaaaagtttggaaaacggtgttgcttaccggttcactgttgacgtaacggcaggtatctcttcggcagttctgacagtagaaaaggtaaaaagatagacggataacgcagaagattaactaaatgagaaaggggctggctctataaaagagttcagcccctcttgtttatgcagaatatatgttccggatttagcttaaaccttctttcgcctcctcttgtggaatacgtaccgaagtgtaaagctcaagaatggcggctatcgtcagagacacaatccattcattgccccttgtaaagagcatgaatgcccccgtaagcaccagcaaaagtgcaccgaatatttgctgccgacgcaggcgtttgacggtgggacttttacacttggacggagaattgatttgtgccaaagcaaccatcgtagcaccgacagtatatatataaggtgaaagaggccagcccgtaatataaacggcagctccagccaggagcatcacggcccctactgcaaaaagggcgggtatcagttgtttcattcttctatatcttcttcaaatacataaatatcctcattgggctttttcatcagatacttctcacgggcaatccgttcgatggcaccggagtcgacggcaagttcattgagccgttcggtattctcctcgtattccttgcggtacttttctatttcatcgcgcagacgactttcttcccgggcgtaacccaaacggcgtacaacactgttctcatccaggaacccgataattacagcaaacaacgcaagcgtaatcaaatatttatgcttgcggacaaaagaccagagagaagcaagtttatccatctcgttatctactatttagcaatttatcattcatgatggaacttgcccatcatataacttcacgtcacaaagataagaggaataaccgaaagatttcttttttttgtgtacatttgcacaaaaagcaaagaatatcccgaatatggaaaactatatcgtatctgcacggaaatatcgtccctcgacctttgagtctgtggtaggccaacgtgcactgaccactaccttgaagaacgccattgccaccggaaaattggcgcatgcctatcttttttgcggtccgagaggcgtgggaaaaacgacctgtgcccgtatctttgctaaaacaatcaactgcatgagtcccacagcagacggtgaagcatgcaaccagtgtgaatcctgcactgccttcaatgagcaacgctcctacaatatccatgaactggatgccgcctcaaacaactctgtagatgacatccgccaattggtggagcaggtacgcattccacctcagataggtaaatacaaagtatatatcattgatgaggtacatatgctgtctgcctcggctttcaatgctttcctgaaaacactggaagagcctccacgccatgccatattcatccttgccactaccgagaagcataagatattgcccaccatcctttcacgctgccaaatatatgatttcagccggattggtgtggaagataccgtagcacacctcgcatatgtcgcttccaaagaaggcatcactgctgaaccggaagcactgaatgtcattgccctcaaagcagacggcggtatgcgcgacgccttgtctatcttcgaccaggtggtaagcttcagcggaggacatatcacctataagagcgtgattgaaaacctcaatgtgctggactatgaatactacttcaaactaaccggattctttcttgaaaacaaaatcagtgacgcgttgctattactgaatgatgtgctcaacaaaggcttcgacggtagccacttcatcaccggactttcatcccacctgcgtgacttgcttgtcagcaaagacccggcaacactgccgttgcttgaagtgggtgcaagcatccgcgaacgttatcaggcacaagcacagcaatgccccctctcctttctttaccgtgccatgaagctctgcaatgattgtgacctgaattaccgtgccagtaaaaacaaacggctattggtagagcttactctgatacaagtggcacaactgaccgccgaggaggacgacggcaccaatgggcgcagccctaaacaagctataaaacccatattcacgcagcctgccgccgttcagcagccacaagccactgctgccatgccccaacaaactgtacagccggcagtacagccaaacagaactcctcaacctgctgctacgcagcatggcaatactacaactccacatgctacacctgctgccatattaatggcacaagggagagaagagaaaaaaattccggtcatgaaaatgtccggattaggggtatccatcaaacgcccccatatagaagaggaacaaagaaacccttcatccaactctactgccgcccaccaagcagcacaaccagaagaggactacatcttcaatgaaagggatttgaactattactggcaggagtatgccggacgtatgcccaaggagcaagtagccatagccaagcgcatgcagaacatgcgcatcactttaataaatgacacaacttttgaggctgtagtagacaatgaaatcgttgccaaggaatttaccggcatgatacccactctgcaaaattacctacgtacccggctaaagaaccgcaaagtcaccatgactgtccggattagtgctcctactgaaaaggtacgtgcctacggacgcgttgaaaaattccagatgatggcacaaaagaacagtgccctactacaactaaaagaagagtttggtttggaactgtattaattccttccaatcgactgcataaagttgctaacaaattgagtataaaggagaaaaaagcatctatttaattttttatttactcatttatatttatttttgccaataataaacaaaagaggcaaacaaacatttgagaacaaaaatgattatatggatgctattggggcagctattgtatacttctgtcttatcagcacatacaatagccaatcaagaaaagcagagtattctgcaatcattggtcaaaagacaagttctctatgatgactccatatccatagacagcgtcattacgtggagtgagcaacttctttccaccctacaatcaaatgaagatagaacgacgtattttctattacaacttcaattggccaatgcctacacattgcgcggcgatatcagcttagcaacgaaccgggcacaacttatgtacgaagaagccaaagctacagactaccaatttggtatggtagtggccaaccaggccattggagacgcctataacacaatagccaacatgggggataaagccctggaatcataccaggatgctttgactgaactatccaacatttcagaccagcatccatatagggcacagcttcttttaaaaatgtccaacgttctgcaacggaaaggacgtctggaagaagcagagaaaatcctggaagagctggaaaaaatattatatcaagagcctgactacccgacagacttctttttctgcatcgaaaagacgaattttgccatttcccatgggcacctctcacaagactatcttgatgaagcaaacatctggctccacaaaatagactccatttaccaactgcacccagaaaagttctaccggtttcacttggattataccactgctgcctactatagagccatgggaaatttggacaaacaatactggaaacaagctctggacatctactccaaattgcaagcagaatactccggtaataagcgctccacgtattaccgctggacttcgctggaaaaaatctatctctgtaaaatacaaggcatggccatggaagcctgccgaatctaccaggaattgtatcctcctatagatacactcgcttcacaaagctatatccggcaaatcaatacgataaaggcaaaataccaggtagataaggcagagacagccagcaataacgaatacaataaaatcataaccagcatattggtaggaacgatggcattagtaacgttatttgttctacttgccatcctactcaaaaggcagcgggaaaaggtgaagctctccacccaaaaactagcaacatcacggataaatgccgaaaatgccatgcgtgcaaaaagcgtgttcctctcgaacatgagccacgaaatccgtaccccgctcaatgcgttatcgggcttttcatccctattgacggaagagggactggacgatgagacacgccgtcaatgcaatgaagttatccaacagaactcagaactattgctgaagcttattaacgacgtgatagatctatcgagtcttgaattcggcaaactgcaattctgtattgtacaacatgatgccgtaagcatatgcagaaatgtgatagacactgtgaataaagtgaaacagacacaagctgaacttacattcaccaccgagctggaagaaatgcccatcgagactgacgactcacgcctgcagcaagtcctgattaacctactgataaatgctaccaaatttaccccacaaggcagcattgtcctaaagctggaaaaagaaacggacgataccgtactattcaccgtaacagataccggttgcggcattcccaaagacaagcaagccaacattttccaacgttttgaaaagctgaatgagaatgctcaaggcagtgggttgggactctccatatgccaacttatcatagagcatatcggcggacaaatatggattgattcagagtataccgaaggctcacgtttctgtttcacccaccccataagccagacaggcagaaaggagcataagaaatgaaacagatatttacattgctcattgccttatgctggctattaccgtccgcacacgcagatgtgcgacgggcagaagtcaaggatagcctgctacgtatatatctagcctctccagccgataccaccagattgagaactctatatcagatagcactgcttgaccaactgtcaccgacattcatctattacgagaacaaattactggaagaggccatcgctcagaaaaatgtacattaccagagtgccgccatatatgcgcacattatttattactacaatctactggaccaaaaacgtgcagaacaatggctgaggaggctcgaacagttgtctgaagagcacaactactaccgccattacttcagaggcaaaaagatgatgatagaatgctatatcatcagccagaagattgaattagccctcaaacaagcacaagacatgtacgacaaagctcaaagtctcggcaaccatgacggtatgcgcgaagcatgcctatgcctgatgaccggatatttcaataccttacgttacaaagaaggaatcacctacctgaacaaggcttttgaactgacaaatccggactcctcccttgccactcagattgatttattgacaaaagcggtactggcttactcatatctgcatgacaatggcaacatgttccggtatctggaggaactcaacaatgccaaaaatagattgcaggaagaaggcaccaccgtactgacaaacggctataccaatttgtatctgctcatagatttacaatacgccctttactatacccgccttcaacggcctgcggaagcatgggaatatttgcagcaatcagaacggcatctcagtacatcttcatttcttccttatcggttgatacgtttggcagcatatgccgaatattaccaactgacaaaagaatacgacaaagcgttggcttatttagaagacgccattgaacttgtaacccctatttcactggatgatgccatgatttatggacttcagaaagcggatatactagtaaagatggggtttccggacgacgcacttcctatctataaacaaataaccaaggcaagagattcgttatatacagtattctccacctcacagatagaacagatacaaagcctatataatatggaccaactgcttctccaaaaagaacagcggcaagccagttttcaccgtatctgtctggtcacctccattatcatcattatagccttgttacttttcaacctacatatgtatagaagcaggaagcggctgcaacaagatgagaaggaaatgcgtaaattggcaattattgccgaagaagccaacgaagtaaaaagccgtttccttgccaatatgagttataatatccgtattccactgaacaatgtagtcggtttctcccaactgctttccaccgacaacgagctggatgaagaagagcgaaaagagtattccggtattatccaggccaattcgggtgagcttatccaactggtaaacgacgtattggacctctcacgcctggaagcgaatatgatgaaatttcaattgcaggattgttatgtaaaagaatggtgcaacgaactaggttttctaatacaaatgcgcagtgaaggccatatcctcctgaaactacaagtggaggtaggagatgcgcgtatccataccgacgtcaaccgccttacacaaatagtgacaagtatgctgctttatccaaacgactgtaaagaaacgcgcaaagtcagcatgttcttggtcaaccatccggacaaacacatcatagcatgccggatagagaacagcccgatagccgatcccaggtttgcctctcaaaaagtatcagtgcaacagaaaatcaaccagttgttctttgaacatttcaaaggtacctatcaaaccgagaatgtcgaagaaggagaaatcgcagtgattacttttacctatccgactctttcttaaaagctgaaaacctgcttaagttccagctaaagccaatagtatcagagcaattcgtttacgaagttcaaaaatgaacatttttcagtctctgcggtatgctatgccgctttctcgactccttatttagacgacatacaaattatacgtttttaatcaagattgatagcaagtaataaagaaaaccactatttttgccgaacgaattagtactaataataatttaaatctaaaagaaaatggcttacgtaattagtgacgattgtattgcttgcggaacttgtatcgacgagtgtccggttggcgctatctctgaaggtgatatctatcatatcgaccctgagacttgcacagagtgtggtacttgtgcagatgtttgtccttctgaagcaattcatccgggagaataatacaatcccagtatcaaaaacaaaagcgtgggcagataaactgcctgcgcttttttatatcccccacgtaagattcagtaccttcaaacccttcattgttattttctatatacggataacacattagttcacagacatgaacactttgttccataagtagaaaacaaaatgttcgtacagtataaaacaaagtgtttatactgtatggaacagagtgttcgctataatgaaacaaagtatttgccataatgaagcagagtgtttgccataacaaaacgagcagtccgctttgatgaaacgaactgctcgtgacagcatgacagatgtcttgctaaaataagtttgtagaagaagttagaatcacttcagattagccagtgcttcttttatacgacggatagcttcaactatattttcatcgctggttgcataactcatacgaatgcattcaggagctccgaaagaagcaccgcctacgcaagccacatgagccacttccaacagatacatggccaaatcatctgaatcattgattttacgttcgccggcagatttaccgaagaatgaatcgcatttagggaacagatagaaagcaccttccggtacattcacctcgaaacccggaacttccttggccaactttacaatcaaatcacgacgacgctcgaaagccttgcgcatttcctccaccggagcttgtgtacccgtataagcagcctcagcagccttctgagatacagaacaaggaccggaagtatactgtccctgcaatttattgcaagccttcacaagccattccggacctgcaatgaaaccgatacgccaaccagtcattgcatatgctttggaaacaccattcacaatgaccgtacgctctttcatttcgggaaattgcgctatgctctgatgcttgccgatatagttgatatgttcgtaaatctcatcggcaatcacaacaacctgcggatgctttgccaatactgcggccaggcctgccaactcctccttgctgtacaccgaacccgtagggttagagggagagcaaagaatcagcgcctttgtcttcggggtgatgacagcctccagctgtgcaggtgttatcttaaagtcctggtcgataccggcaggtacgataaccggcgtaccctcagccaactttaccatttccggataactgacccaatagggagcaggcacaattacttcgtcacccggatttaccaataccaggattgcattgcaaaccgactgcttggcaccattggcgcaagaaatttgtgcggcggtatattccagaccgttttccttcttcaacttctctacaattgcattacgcaaggcaggataacccggcactggagaatagcgagaaaagttatcgtctatcgcctttttcgcagcctctttaatgtggtcgggagtattgaagtccggttctcccacactcaggttaattacgtctacgccttgagccttcagctctgcgctcttttgagacatagccagtgtcgcagaaggcgacaaactgtttaaacgatctgataattggttcattttgttactatttaatgattgttacgcaaatccggttgcaaaataagcgattttctttgatataagaaaacaaaaagacagttacttattgaaatgaagtgtatgtcccatacgttctttcttggtacggagataacgctcgttgtatggattcggagtagtctcaatagctacgttctccgttatttccaaaccgtaagcctccaagcctacacgcttcacgggattattggtcatcagccgcattttgtgcactcctatctcacgaagaatctgggcacctacaccataatcacgctcgtctgccagatgtcccaggcaaatattagcttctacagtatccatgccttcttcctgcaatttatatgctttcattttttccatcagaccaatgccgcgaccttcctgattcagatatacaactacccccttaccggctttctctatcatctccattgccttatgcagctgctcgccacaatcacagcgtttggaattgaatatatcaccagtggcacaagaagaatgtacacgcaccagaatcggttcatccaattcccaagtacccttgaacaaagctacatgctccaaaccgttcgacttctggcggaaaggaatcaaacggaaatgaccgtggtctgtaggcatatccacttccactcctttttctacaatagactcctgcttcaaacggtaggcaatcaagtcacggatggaaatcaatttcaagccaaattcatctgccattctacgcaattcgggcaaacgagccattgtaccatcctcattcattatttccataagggctcccgccggataaagtccagctaaacgtgccatatcaatagccgcctccgtatgtccagcacggcgcaacacacctttctcctgggcatacaacggattaatgtggccaggacgcccgaaagtggccggagtagaagccggatcggccaacgcctggatagtagcagcgcggtctgccgcagaaacgccagtactacagccttccaatttatcaacagtaactgtgaagggagtacccaatacagaagtattatccgatacctgatgcggcaaatccagttccttgcaacgcgaaactgtaattggagcacaaagcacaccgcgggcatgcttcaacataaagtttactttctccggtgtaatcttttcagctgcaattatcaaatcaccctcattctcacggtcctcatcatccacaacaatcacaaagttaccggctttgaagtcttcaatggcctcttctatcgtattcaactttacattttccataatctattttgtttttatttattctgatctctttctataattccaatcacatcttcatttgtcttgataatccgctccatatccttattcagacggatacggaatgcccagatacggaaataaaagaacaagcctatcgggaaaacaataccgcagagcaagtttaaccaataattgcggaacggacggacatgcgcatggacggggatgaccggataggtgttcagcgctgtcaacaaagtaacggatcttgtattcgacatctcatctatcagactctccaaacgttcgttaatatcttccaccgcctcatcctggctatcagtcatccacaatttaaagtaattgggagcacgtttcaacccctttctatcagcatattcacgacagtctacggacaaagccttcagctcttccggaatacgtgtataatcaggatcgtggatgattacttccttacggaacagatggcgtacactgcgaatgcccacaaccttcttgaaccaatttatataggcatcagcattcaataccactgaatcattgttggatttatatgtcaggaatgcacccaatggggccaagacagcggtactggtccacatacccatccagacaacccactgtccgtcacgagccatcttataccctgtattgttgatgatgtaatagataataaaaatcaatacagaaaccaccaccggcattcccaagcctcctttacggataattcctccgagtggcgcgccaataaagaagaagatgagacatgccagagaaagagtcagtttctcatgccaggaagtcatgtgccgccgaaggctgctttcagtctgcgatatattaaagctcttaaaactccagtcactccccgcactctctgcacggctgacggccgtggatataaccttctgtttctgcatcagtgtagccacattgtagaggctgtctacattgtactcacctaaataagccttttcaatcttcaatgtatcctctttagacaagctggctgtcaccttataagttcctgccatagcttctttataataaccacgccccacactgtcattctgcaatttcatggagtcaatgtccgcctgcagcattttcatatccttactgttggactgattactcatgatacctgcatccaccatattgaaatccgaattgaactcaatgattgcatgcttttcgcggaatgtctcacgccggtaaggcacattcctttggttcatgttctgcgatttcaaattctcaaactgctcaccactgtataaatgcaaatataaatgctgtttgtcagccgtcatctccagacgtcccgaatcagacttgataatttgagcattctcaaaacctttctcaaaattatatatcagtacgtcatacagcataccagttttgcggttcttatgcttcacatacagattataaccatctatttcatcgtagaacacaccttcaggaatatccacttcgggagatttctgcttcatggaaataagcaaagtccataattttgtttgggcttttggtcctatgacattttggaaatagaaagagacacaacagatgaaacaaataaagataatcaggggccgcatgattttcaataaagaaataccggctgccttcatggcaagtaattcaaaacgttctccgaaatttccaaaggtgataagggcagccagcagaatagccagcggcaacgacgcaggtaccaacgaaagcgcagaataaaagaaaaactgtgcaaggacagtcatctccaatccttttcctaccatttcgtccacatacctccataaaaactgcatcataaagatgaagaggcagatgaagaaagtacccataaagagcatgcaaaagctcttcaaaacaaatatatctaacttttttatgcgcagcattttactcgtttcatgcaatgagagcacaaaagtagtacaaaaaagggagtacgggaaatttttaatctaaagttaactaaaaaccacaagttcttcgcaaagtatccacttgcgattcccataattcacgcgaatcacccacctcgtctatatcggcaaagtctgttatctccaatacgaaatcattggtcaactcattgtttgtcatcttcagttcaaagtattctcgctcgttctcatcgtccagccagcggaagcggatgaatgaatacgctcgcacggcaataatctcggcatcacgtttttctgtttttccccaaaaaaaggttactgttttatcgtctgactgaaccctatcagcaaaccagccctccaaaccagtaggggtacttatcgctgcccaaagaatacttttagaagtcgcattcaagagatattccaaatgtattttctttctttccatagtctattctgctttttattgcgccagccaagataaatacttttttctaattacagaaaataaatcatcaaatttatttatatctccctttccatacacccctaattcattgataatgttatacaaatacgtttaataaaaagtactgcaaaccacttcagcaccctatcagcaaaagaaaaagcagaaaatatccataaaagttttggcaatttaaataaaagctatatctttgcacccgcaatcgagaaatgatggcgggatagctcagctggttagagcgcatgattcataatcatgaggtcaccggttcaatcccggttcccgctactaagtcgaaaggcttgtaaattaggcaattaggaggcttccactcttggttgtcttttttatttatagaggtatttgcacagattttgcacggattttaatgtaaaacactgataatcaatgaaaacgtaagataattctactttaaaatctctttcttctgttttcttttcattgcttggtttttcttaacggtaatgttcgagataagacttaagatgtccaatgatgaggcttgaatcacaataaaatcattctcgaatgatgtttcttgcacgaaatcttgcacaaatgaatatgagaaaagagataagctacacaccggtaattacctcttttcatcgcgataaaattgagtaagaagtacatatcttacaattttcttgttttcatgtaatattactatcgacaaccagctttcaagcaaaagcactttcaaacagattaagcgtattcaagttataaagttatacctcatgaaagagcatctcaccgttaagtgatttgataatcgactttcaagcaaaagcactctcaagccaattaagtacattcaaattataaaatcatacctcatgaaagagcatctcaccattaagtgatttgataatctattttcaagcaagagcattctcaagccaattaagtacattcaagttataaagttatacctcatgaaagagcatctcaccgttaagtgatttgataatcgactttcaagcaagaacactctcaaagccaattaagcgtattcaaattataaagttatacctcatgaaagagtatctcagtgacacgccggcgtcggagttcgccttgacgccttccgagatacccttgacctgtgcgcctacgccggtctttaggttggcacttacgctgtcgaaataacctgtgtccgccataactgtcagtctttatcgttatttaactcgaaaatacaaataggcagatgcaacaatggcaatcacaatgattacaccgagccaaaatcggaatccggttggacccaataagtcaagaaagaagtttcctccccagcttccgggtctggcgtatgtccatttccagtcgaatatcagtccgacaagccaaaccaatagcagaaagattactactaagtaccccactttggggttcgcataggcatattcggttgcatcagtgaacagcccttcaagatttcgcaatatgttgttcagccattccattgtattttcctaaatttcttttatactcatacaaataattctcccagtcatctcctaacactttggtcagaacttcatttatttcatcgtcactgaccagcttagagcgtgccgaactgtttaacaggcttaatagcaggagaggataagaggagttctttatcaggtctatggaaagtttgtctgaaagtctgaaaccttccacataacattccgcagctaacgatttctcataattattttcccggcaccaaccacacagtctcaacgcttcactttgcattaggtaatcgttgcatctggagtatgcttcagcaccgcgatagtacgtctctgccgcttctttccaaagtgactctcgtacatagatggaggcctttcccaataaggtgtttccgagcaatcggcaggccaaagaggggtctaatttttcttccccgatttcagcggcttctacggctttgtcggcaaagtacatggctgtcttatagtccttatgggaaatctggtcggtatatagaattgtatatacggttacaaattggctaatccagttaatgtttttcttcacattttcgagggcaatgtcgaggcatttcttcgcaaattcctctgtttgcgttgcgttcccttttttcacactgttcatcagtttgattaatgccagcctgaaatttgaggctgccgggtcgttcttatcctcatttgccgcttgttccgcaagttgctccattgctccgtccaaatctattggcggataaatagacaccgcgtcattggaatgtttggccattagtttgccaaactgttcatggtcttttatgtcggatataccccataccatttgcttgtggaatggcagggcaagagccttttcaaaccattcacgacatccgtcatagtcgtatgtgttctttaggttaaagacaaaactgcatttcatatcagtcccttttacaagggattctgtcagcttgttgaagttggcaactgcgacggaggcatcgttttccgctacttccggtttataatcagctatccaatcaacacgttcaaaaacaatttcttcgggtttctttgaattgttccaatattctacctgttgtgcaatataccctacaacatcttttgagaaatcggttctggaactgaacggaagttctatgacgaacaccatatcttcctcttcgctatcaagggcaagcatatagtcatagaaagcatcaagcatactttcgtctcccggattgatgacgatacgaatcaacttaaccggtttcctgactgcatcttcccattggtagagcatcttatctgctatttgttgtatggcattgctcatatgctgttaattcaatttgacaattgttccggctacggctgtggttccggaagaatctatcgtagcctttgttgtaccgctgactgtagcactgctactgccggatgctgtaaaatctgtactggagatattataattactgcttgctgtacaatcaatattttctgctgactgcgcaatattggcaccggcggactctgttatgtccttttccgcattagatgatatattgccttcgctatcaatcattattttgttttctccaacacacaaggtgatgcttttagaggcagatattgtgatatttccttctccgtctgccgtatagctgttgccttccttgtctttcatcataacgcttcctttttcatcatcaagcgttatggtacaaccgctgcgggtagtcagactttttgttttgtttgaactgccgccaccggtacctgactttccatggaataagctgccaagcacaaacggacggttcgggtcgtcatatctgaatgccaccatgacttggtctcccttttcgggtatgaatacaaatcctctgtttgtggccaccttgtcgcttgtgcctgcgtcaggagtgagtacccgtatccacgaggtttgcatcggaccggtctgccagttcatcttgacttggacacgacctaactttttcgggtcctcgttgctgacaactacggcctgctgtgtatgcgcgacaggcagaggcacatctgggcatggaagggtgggaatagaggacggaagtgcggtgaaatagttctggtaactgtcacccatgccggctacgtgggttatttccgtaatgatataggtgccgatactgttcttgacgaatattttgattccggaatgaatagcggtgtggatatctatgatactgcccaccgtgagggtatagcagtcgctctctccggtgacaaaacaggatgcggcggtgtcgccttgctgcttgcgctggaagtaggcatcaagctcacccttgttggtgatgcgtggttccgaacgttgtacggcgggagcggtaaacagtgccaatgacgagtcaaaggccgcttgtcccaatgtgttctgtccggctgcggcatcaggggactggccgttataggtctggtcgttcaccgaatggtaagaacttccctttattggtcgggcaagtgcctgcgagcagacgtcgagcacggatagttcctcgccgtatatcagcttggtcgttgagccgggctgtggcttcccgaaaacaaggttctgtccgtcgtaatagagccattcctgatattggcgggcaagccgttgtatgaatccgaagttggtttcctcgtactggcattcgtattccaacttcgatttcgtttccggattgacaagagcttgcactcctgccttatctgtaagttccttaacgatgtcagacaaggacttgttgcaccatgaggcacaagtgtggtccgactccagtaggaatgttgacgaatatcccgtcacttttatatttccgtgtgtcccaccagcacgatgaagtcctaccatggtggcgatgccgatgaaaatagtgccgccgaagtccatgattacttttttcccaatccagtcctttgacacattcggtatttccacaccataaatttctacggcctggatatccagcgttatctcaaaatagtggtgctcattaatgctctgtttaagcatcagttttacaaacgacggcatggggatgccggctatttccaatgtgacttttttttgttccagcatggcggcattatatttgacggtttatatccaaattgccaaagccgcccggcggaagtccgtcggacggcctgacaaatgttttgattttaggatttacctatgtacgccgatttatttcttcggccaacggttgtcaagagctgcgctgccgacagtgatttcttcagcggagaacgtgatggtgattgtcataggcacatcgttattcgcgtccagagtttccgagtagtgaacgatgtatgcgttcttgaactggatttccttcatcttggcgtcctcctccgttttcttatagataatcttaccttctacgggtttgaaagcactgttcagcattgactcgataacagaagtgtcttctgttgattcgatagttacttttactctaccgcccaatacgcttgaagagggcatacctttagagtccgtgttacgactgaactcatagtttgaataaaggacgtcaaattccttgttgttaagttctaatgatgctctaaatgccataattcgttggatttaatgagttaaacttaatttttactgcggtctctccgtccttgcgccctaaccggtatagatgcaaaaaagagaaaacctcaaaaacgattttttgaaatttcctctcagcctccggatgactcagttttattgtgggaaaaagagaagaaaataaaacatcatctttgatgtgagcaaatataagtgcttatcttcatttctccaaattttttagcgcgtttttttggctgttgttttcattttaacacgttttaaactaatattcgtgtataaagccactgtcctatatgattaggaatgtaccccgttgatgatgtgtctctattgaattgattcccagtattgtaatggcactttcagaagacgtttcatcagggatggacgtacccgtcggaacgaaaactactgccggaatgcggaaaaaacggtatccaccgcatgaaagtggcagataccgttggcagattgactatgtagtctgaatctttgcgtatatcctaattcttgcgcccatatcggcagatgagcaatgaacttaataccaggagtgcaagggcaatcatccatgtgtagattttccgttccttttccaaatgttcgatgtccgccgcttgttgtttggagcaagttgtcagtatattaatctgggattgttgtgccttgcagatatccataagttcagcattaatccgttgctgtgtttccagcgaagtttggatgttcttgaagttacggttggtcgtatatgcgtcgcggatatatccgggtgtgcttacctgtaacgacggaacctgtatgctgtccggaaggtatgtcagttctgcattattgcgccgctctgttgcgaagctgttgaacaggagtatgccgacgagtgtgccgctaatcagaaaggctattaacgctatgatggcaaatattgtgtttgacggtttcgcaacaggtggttggtactctcgttcaagccatggatgatggttcatcgtgtgaggcggtatggatgtttcatactccacagtccggacttcggcattttcttcggtctcttttttctcaagggccttgcgtcttgatatatccataaattcgcgcttggcaatctggtatttatctgcttgataaatgacaaggtcgttttttaccagccagtcaagaacgtccttgacactccgttctgataccttgaggttgctgatgctccaaaatatctctgcacaagatacccatattggtttctggaggcacttctgatacaagatttcaagtatctctgcctgtagttgttctcttgttggttccatttatttacagtattaattgtttcggaataaaataatatttcttgccggctatgaatacgggcctgaaaaggttgcgttgatacatatcttccagtcttttcatctttgaaatcagggctgtatagccactgttaaagtccgtcagctcaacctttcttttcttcagtttcttcacctttgttgaatttaaaaggctgtcattggccatgactcccgtcttataatagaagatttgagccagatatggatttctgggcaatacttttcgatagaaacttctgtttatgcttttcttttgccgcttgaattgcttgcgaagcactcttaactcctttttccctatgttatctgaaaactccgggagcagtcccctgtagctttgcagcagtcccatcacttccctgtcatcgagtagatacccatattcgtacccgttcattatactgtccgctacggaggcctttatatagtaggtgtcattcacgctatttctatctatatcgtcaaggctcgtactgtcaggattttccgtatgatagaatatatgcgtcaattcggatgtgggacggcttcttaagacacctatatttcgctcataatctttaagcgagtacaacagtaggctgtccgtctcgaaagattgctgaaacacggaatccaaggctgtttccaaagcgttgctttccagcctgtttcgacctttagggaacaagattcctcctaccgtaaggctgttgtatggggcatcatacaggtataagttggcatccgtagcttctatgttcttgaacagttccgtctttaccagtctgttgtctgcgatataattggatatatggtctatgtatttcgtagaatggctgtccagaatggatttggcctgcaataggaagtcctgatacgcagtacctgacgctctgtctatctgggcaaacagaagccttgccggttgggttgccagccacgagagttgttgttcgtgcaaggataaagtttgctttgaccctaaaatgatgaatacattgttgctgaaacggctttcgttatcatagcaggagatttgtttgatagccccgccaaaaccgtaaaacgatgattgttcctcttgctcgttctttcgcttggaagaaatggattgtttgatatagtcgagccaggctgaaaagtccttggtgggggccaaatgtctgttttctccgttgaaggatatgcaagttgccgaaaatgtgtagtcatatccgggcttcattttcagctttaggttctgtagtacattgatatatggggatagataaggtaggtcggcatcattgaacagtacatgtatgttcacgtttttgttttccgcttccatctttcggacatcggaaaccatgatgtctccacctttgatattgataatcttattccagttcttgtcccagacggatagaggatagttcagccggatattcccgtccgttataggccctgccggatttccatccaagttgaacaatatcgtaccctgaatattcgcattatgtagtgccaacgtatcgggatacatcaggttgacggcacataacaaagaatcacggtatcgtgaataatcaacatgatacacttcattctggccgacttctgcaagaaggtcagcgggaatccatcctaagaagcgtttggtactgtctgacaatgcgggtgcattggaaatcaatgcggatttgccgctcttgtccagcttatataggtaaacaacctctccgctgacaactaccgcatccgttgttgttttcagaaacggctctccgtatattttcagggtatctccattgaagaattgatggatatcgaacagcttgttaatgctgtttatgcctatacggtaccttattggctggttgttgcggggattgatataggcatggtcgtacatcagtatattttccgatggtatccatccggcataattgactttacggggttctttaaagtgcctcttgctgttatacaggaaacctataatcgacttgggcttgcctgtaatgtcagggtcggcctgaacgagtttgtaggttccgttcttttcacctactatgtaatagggtgtaccaatcccgtgtgaagaccgcttacgctggaaatacgggtcttcataactttgatttccggtcctgtccgaatagacaattctgtttgtcttgcttttctttgttttgacaggtgcttccgtggattccggataattgaatatatccctatccattatttgtatcctgtcgcggatggacacttgggcagatacgttgcacgcaagagtcatcatcacggccacagaaaacagatttcgtatgagattcagttgtttcatttttcaatataactttgtgtcacatggatggacttgacgcaattcaaatcgtcaatcttcacatcatcaatactcacacgctttttcctgttgctctcaagaaaatgcagtccttggcaatagccgttgaagtcattgtatttttcatcattgatgatgaccactacctggtctgcatcaatgcaaaaatattttttacggatataatttgtatgttcgtaatagaccgacttttgtgagactttggcgtcagctatggcttgcaggtgtttttttatatcattctgtaccagtgccaacgaatctaccgtgaccagttcctctgctttttcaaagcgtgggagaatggttatacggtgctttaccggatatttcgtcgtattggtttgtaatgagatggtgtattctcccggaatatcatacgaatatacgacttgctgctcgtatgcgtccacagtaccgctttcgccaaattcccatagccatgtgtccatgccatagccttctgccgaaaagaccagctcttcgccttgataaccctctgacactccatttatacggggtatggaatcaatggcctcatgctccagtcctgagataaccttgatatacttgtttacggagtgttttccgtctattttcaaagtaataagatatttgccggccttacgataagtgtatgacacatccgtatttctcatcagtgtatcgccgtttcccatttcccaaatgagctgcttgcctttaatcgccgccgtatcgttgactaacagctccaaccgctcattgacctcataatgaaaattatcattggtgtcatacacataaaagtcaatattggcaaggtgcgacttcgaaggcaggaacaagaacaaaaggatacctgccatggcaaccagtcccaatatgatgattgttatagttttcttattatccatcgcgaatgttttataaattggctttacattcttccaaatcccgctcaatcagtgcattgttgtgtaccagactgttcaattcctctttgatgtcgaattggcatttaagcactctggaggacaacacgccgaaaaggaatttcgtattcatattattttccttgtatatatgctgcaattggtaaatcccatccttcacttcgtccatcttttgtacctgatggatgttgaagtccaaagagtcgatttcattccagatgttctgcgcttgctgcatatgtgtatgctggatttcaaaaatgcgctcggaatggttgatgtcgtttatcagttccgaactgtcctctgtcggtacgttgagtatataccggcaaagtatgatataaattgcggctactgagaaaatcagcagcaggagaaaacggatgtttccccatagcacttcgtcttttgtcatggcttcgtcagtttattcttggttaattcctgatatttgattctacacttttcaagttgctccatgttgctttcacgctgtttgctttcgcggtcaaggtcatccatggatgactggatgacacgaatctgttcaagcatggctttatacacttcgtacttgcttttatcggcctgcatcgcaatgtcattttccatcaataaccgttttttggttatcagtttttgcatatgcttgtgttcactcgaatttcgccgcttggtcttcagattgttcaggtcccggaacaattcttctatctggaagttaagttctgcctgtttcttgaacacattgtcatattcggccttcttgctttcaagaagggatattcccttttgtgcagtcacaatcgttacgacacctccggttgtggtaacaatcagtgcgatagcgaataccaaagtaaatcggagtttcgctttcaaacgagcttttttgttttctgcttccatatttgctatgatttaatcgctcaacctataaacgaccatgaccgtttcttttgagcttctattgtttcgtgactttcgtctcctactataatattctcacgaaccattccgatgtattccagttcactcattttgtggaacatattgctgagcagtgtcacaagtgcccctgccgtctgcaatgattggtttatattggtatggtcatacataagtttggttacgctctctatcttcgtgataaattcagagggcgtgacattggtccactcatagaagtattggagcaattgttctctttccgtttcggaaagactttgaagagcggagttcagaccgtttgcaagttcgttcacggcctgcacaagatatatcggcggttgctctaaggcaatttgctcgataaagaagattcttgagttgtaaaaggcagagaaagccttacacagctcaaatgtgttgttggcaagcgtatctctacgcttgtcggcaacattcctgctgtaaatgagtttcacgtcttcttttatagactgtagggtacgtgccaattgggaaatgaatgttttaatcccatcgtggcaagcggaatgttgtaccggcggaatatattgatgattgattttataggtattcccttgtctgcatacctctgccaccagcaaaaaattctggctgtagaacgatttgttgacttggttcttggggacgatatggagttttatgctcggcaagacatacgggtgatgcaaaggcacctcttccgggtccggttcaccgacaggtatcaagtgatacggatctacggatattagtaccatatactcgctgtcttcggcttgcaggccggattctgaaatggttgcactgggtttctcatccccgtataaaccgtcgtaataaacgatgggcagaccgcctttggtgattgcgttacaacttttcaggcggacacagagagtggacatggtatcacctgaaatctcaatttcaagattgtcacctatcccttcaagaacctctccaaggccatagttataactggtcaagctccttcctgcttcgcggttgagagcttccgtttggctatactggtttgcaaagaaatgcttgctggtcagcttcagaccattgacccagtttacaggcaaatatgttagtgttttcatatattatgatgtttttgtttctacttgtactcgccggatatatatcgtttggttattcttaatcttattgccctcactggtcagagtggggtcaagtattcttatgaacaacgggaagttaaaccattttgaggtatagaacatccatccgatttgcatatcttccttttctgtttcaatcttgttttgggggaaacgcctgttttggtcttcgataacccaattgaaccagtttccaagagatatttcattgggcagtcggacaaccagcgaagcgtatgtcgggtcttttatattccgtttaatcttgactttgaccgttcggaaaccgaagttgtctatgttgtcccaatatttccggtcaaaggttccatagctcaattcccatggggtgtatatcggatgcgggatgtccaggaacagggttctgctgtacataatcagatacgggattgcaaaccacaggatatttgttgtgttccatagcgaataaggcagcttgcttatcagttcaaacagcagatagtagcaccatccgcctaaagcgcatatcgtggttagagtgagaatgaccgctgttcgggaactgccaataccgattgctccgaacaaatcggaggttgacagtttgcagaacaacgccccaaggaggatataggacagtatcgtgaatgtcaagcctccccagacgtattcattttttaggaaaccgaacaggcagggtaaagcgacggcaatggaagccagaagaatgaatatgattaatttcttcaggctaagtttgctcttgatcgtttttattccggtcaagacaaatatcatcacggctacaaataatggagccaataaataacgtgcaaagaaatatagcaatatcttcatattattagatttttcataagttcatattatatcctaatcggttttctccgagtataaaatccgtttctccacataccagataatcaacttcgatatttcttgttgaaaggatgaaaaattcaagtatccggcggacattggatagatgcgtttttacctcctcatagtcatctgtcggagtatcaaggatgattgtcgccgtcaaatcatcggtttcacttatcattagaccattaagacctaatgtctgtccgatacatccggaaccgactgaaaggtaaaccgtttcatcaatctcatggacttccagtcgcagtttcaccttcaatcccaaaacgataaggaacagttgctcgatagcgggcaggttctctttataccgttctgcattgcagaggaataggaacagcttatatttctgatggggagtaatggatagctcgatattttccattacttcaatcatcttgatgaagttcttcttggagtccgggtcggaaaagaaattcagatggcggttattgatacggaccttttctttgaaaaattcagtatcaaagggtgcaaagaattgaatcagctctttgtcctgtttttcattggctcggatggcttcgactatctccttattgctcatgcccggtgtgctaagcaccaagggatgaaatagtaattccggcaattgatggtagatgctgtttcttgccagattcagcaatatatattctttgccggcatttgtcgttgcgacatgctgttccgaaacgcttaatacatctctggatttcacacgactgttcataccatggcaattaaccatagtatggtccaacagccgccggtcaagaataaattggagttcatcataaaagatttctgcgacgaaatttattgcctgacttcgttggatgctttccaagggtttcttttgcgctaacattgttcccatatcagttctccgtttcgatagtttatgacgatgttgtcacccggcctgatttgctcagagacaatcagacgagatacggacttcttgatataagttcttatgactcctgcaatcggacgtgcgccgtattttggagaataccctttgtttgccagatgttgcaatgcttcatccgacaaattcaactggatgtttttctgtttcatcagttgttcttgcaatcttccaaaatggaggttgaatatctgtttggcgacattttcatctattggagcaaacggaaccacctcggtaagacgtcccaaaaactcaggtcggaaatactgtgccataacctcgatgagctttccggaatcaggagtatgcccggattgtatttgttccacaatccactggcttccgatattggaagtgaaaatgattatggaattagagaaatctccttcccggcccagtttatcatgtattttgccttcatccatcatttgcaggaaaacatcataaacactgctatgggctttctcaatctcatcgaacaatactaccgaataaggtttctgcctgatttgagtgaccagcagaccgccttcctcatatcctacatatcccggaggtgcaccatacagtaatgcagccgaatgttcttccttgaactcggacatgtcaaatctgatcatggctgattcgtcatcaaacaataactcggccagtgattttgtgagttctgtttttcccgttccggtaggaccaaggaagaagaatgaacctataggcttcttggggtcgctcagtccgctgcgtgattctataatggcatctgataaagtcgtaatagcccggtcctgtcctttgacccgctcttgcaatttgctctcgatgctcaaaagccggtccttctcgcgggcttgtatctttccgataggtatattggtgcattccgctacaatcgcttctatttccgaagagcgtatctcttcaatggactggtcggatagcatctttagctctttgatgatgcccgacaaacgtcctgcttttatcgtaatgtcatcttctttgtcccacacatagttgtctgacagtttggtagtcaacacgacactgattttgctgaacacagagcggtacagcaagtacagtggtccttcagatattttttcgtcgagactccttattttctcaaaatccgtttccaaatcagatatactggctcgtgcgttcttattgcatagtcggacggcagcggcggttcggtcaagcaggtcgatggcggcagatggcaggcttcgctccttaaaatatcgtttggagagtgcgattgagtctttaatacacgcatctgagattctcagctcgtaatagttttcaatcctttttttatgtaattgtatggcattttccagtgtagtcgtatccagttcttcaatctttatgatgtcaagacgcccttctatcggatgtttttcgatgttcttccggtaagagtcgttcgtgagtgtgagaacaagatttgcggctccctcgctgatttgcgcacttaatatgttgacaagcgtggatgccttgcctgatgcgctgttctccaaaagaacctgtaaatcatcaatcaccagcacagcttgttccaattggttgagcttgtgcatcagattgacaactttttgtgctatctccgtttcagacgaggttgatgcgagcaattttgccgtattgagtccgacaatagatatttgctttaacatctcgtcttcattctcacaaatatctttgacaaaggcgttgatgatggaactctttccgataccggattcaccgacaatcagtatccccttgttctctgatcgttcgaggcattctaaaatagtacggacctctttttccctaccgacgacgaagccaccggcattgatggtttcttggtttttcaggttgtcggcataaggaacgcttgctgttatctgcatttcctctccctgataagaatacaacggggtaagggcattgtagtgggacaatatgtcattttccgaaatatccagcatctctatctgctgatgcgaatacacgacaccttcacgtaatatggcggtaaacacacagatggagtctatggaatccgctcctaatttaattttagaccgttcggactcatccaagactttcgacagttcttcgtcaggttccacttcttctgtggaagtgccactggacctatacatttcgcgatgggtgtcaaaccattccattatgtagccgacatccttctgcatcgaggataaaatttcttttaggcccgtgttttctgcaaacatggccatgacaagatgtgacacgccgaacgtgttatgcttgtcttgaagtgccattcctcttgctatcttaagggcagacaccaaacttggactataattgctatcattcatacgaatttgattttatagtttgaattacatacagagcgttcagtcaaatctttttcaagataatgggccaattcttccagattgggaatttcatctttatcaaattgtccaagttttatcttgatctctgtcactctgattaatccttttttgctgtcaggagatatagccacgccattgccgacttcgactgattcaacatattttcccagcttgtgcaacaggtagcttttgatgtcttctttagatataatccgttcccgggacaacagaccgtaccttaaactatttataagttcctgttcgccatcatgcgttgttcctccttgcatacaagtgcgcaacatgatgcccgaagcatcatatttttctatgttgaattgttgtatcagtgtgcgttcgttgaaaccgttcgccagagatccggaagttacccaatattttatctcggcattggtcgcatctttttgggggacacttaaaacaaaggcttttattttgttatctccttttagtgtggcctccaatcctctctctatatcatttatcttgttgaacaactctttgagctgcgtcgaaagtgcatccggattcattgaagcgaaagcactcccgtcttctttcattaattgtaatacttttgaaattaatgagcgggcactgtccgaatcaaatcgttcaaggtcgccaaaatacaggctgaatatacctgttggattttcttcatactggttcagccggtttacatattcccggcctttgttgtcttggaacgagcgtatgttcaagaattgtgtacggctcggacatttcagggggataatccgtccggtggaacggaaattatgctgtttgtaaacgatttgtctgtttacaaccggaaatgtgttcaaatatacttccagattttcaagactttctttcgtgaatatttccggaaaggctatcttgacccaaaagagactctcagagtcatccgggatctcacagtcggacgcataaccgggaaacatttctcggtaggtatgtttctctttggaagcgtttcttatattcacattaaaatataggtcactataaaaatctcggatttcatcaaagtagtgtgcattactatatggatcttcaacatgaaggcctgtttttgcattcagcaggtttccagtgcagtcatagaagaaagccatattcataaacggaagcagccccgtgtcggaaggcttgatgcaaaacattacagagtccattttttgcaggacttctttagacacatccatcccgacccagacgcaataatccgctatccggtttttagggtcaaggaagcgtgttggagtgctaaagccatcggttgaatgccttatgctatcgttatatgcgattgctctgacttttgcgtcaaccagtttataggaaaacaaaggggttataaagacttgaatatcacctttgccaaatatgttcttctctgcataaaaatgatcttcggcatcaagctcgcaacattccccatgattgggggtaatagtcataagcgcatgggccggctttggcagcgaccatttgtttcctatgagtattctggacagacggtgaagtatccgtgagtcggactgctctatttcttgatgcagtttgttggactcatgggcaaaaacttcaagcagcaaatctatcacggggtccatatcgcgtatatcggatacaccccagaactccatagcctgctttaatattcgttcctttattgcaatttgtttcttgtctgccatagttcgattattgtgataaagggcttatatataatgaggtattgaaattgaatttctcgttggttctatccattgttccggtcacggttatttgtgcctttcttcggatatgagataccttatctatattttcttcttctatttccaaaagagtgacgttcacatctacattccgtaacctcttttcatatttctctatcgtttttattaaggagttcttcactccttcctcccaatcgctgattttcacaagttggttgaactcaaggtcccatatcatggaaccaaagtcttctcgcccgataacttccccatgatgagaaagaatcagtagcatgatgtgttgggctatcgattcctgataggaacacctttgcaatttcttggcgacagccgattgcaattgtaatggcattttcaggtaagtcatactattcttttctttattctatttcgcaaatatactattttcctcattagatgccaataaaatacccctaaaaatttgacggtttcagaaataattcatatattgcgcacggtcataaaaccaagagagagctataaaaaaagtatgatattaaaaagtaaatgctatggcaatctacaattatggaattggaggcaacgaagtaaaagtcgatgcgaacgaatccatcgcggaaatcccctccaaccgaactttgatagttcaaaagctgacagatgaagctcctgcggctccggaaagtgtgtatggtttggaaaccattgaagatgtgttccaacgttttgaaccaacagttgacttgcgccacgtggatgcggaaggtaatgaaatcaaggaaatcatgacattcaccggactcggagacttcggggctaagaagattaaagagaaaagtgatttcttgagtaaacttgatattgagaaagagcagggtgtccgaataactcgccagcttacttccaaccgcgctttacagaaagcacttgaaaacccggaagtcaaaaatgccattatggacgtgattgaatcatcaatcgaggagattctggcaaatcaaaagaaagtagaactttaatcttttactaagatgaagcaggaaactcaacaacagacagccagtacgacaacctcacagaaagtcgtatcacaacaggcgcaaaagtcatctgcatcggcaatagacaagctcaaagaatttggtggcttcgcttttcttgaaaatatcatagatggatattccaatcttaatccggcacgaaaggcccgtcgcaacatcttcctcacggatgaacagtgggaaaatgaacgtaaggccttggtgaatcgcttaagcgtatggctcaaactcctgcgtgagaatgacactgccgaacaaatgcgggacaaggccaaggaaaccgcagaaaatgccgagaaccttcttaatcataacttgaagaatgctcttgccagaacacgggaactcgaaagcgcataccgcactattgcgctcttttataagaacacggaaagtgataaggtgaagaatgtcaccattgtcaatgcgaccatggagcagcttcaggatttggacaataccatttttgctgaccacatcagcaatgaactcaaacagaattttgaccgtcttgacctgcgtcgcaactactcgttgcttgtcgttcccggatatataggttcaaatgccattttggacaagtggtccaagattgcatacgagaacaaggcttttcttgttacagacttccaaaaccttgaaactccggacgatgtagtagatatattcttcaatgccaatcatacgggtggagatgtattcaaatcgaatactataatgacctgtaactggttgcttggtcgtcaaagagaggaaagcgttggagaagaagaaaacctttatattccgccatcttcttcacttgccgggaaaatatacaaaaccttaatgtctcaggtagtagccggtaagaaatttggtggacttaatgaagtagaaagtgtacgcttcgaccttcgcaagagtgagatttccgaacttgaacgtatgggtcttgtgccgatggtgaacgagtacagcaaggttatggctttctctgccaagacattatttaatggagataaccttggcttgcagacctactccgtagttcgtgtattcgactatataacgaaagtgctgattgacttcctgaaccgtcgggcatttgagaattggactactcgcacggaagctgatttacgtggtcaggttgtgaaattcctcgatagtgtaatgggaccgaacaaactcatcgaacgcttcaaggttatgaagattgaacaagacccgaatcagaaagaccatgtgcttcttgatatccacgtcacaccgtatttcccggcaaaaagcttcgtgatacagcttgccggtcataaaggcgataatccggaagatgctatttgggaaagcgcatatcgtcaagaataaattggataattttgaatttacagatgggcataatgtatgtccatctgtaaatcatttattcacttatatgaataaagaaaagaaagagtatcggataagaagtaggtgtccgtaatcagatgagtatcctcaatagcgcggcgaaatcggacaagctcttgcacactttaatgtacaagtgaacgagggttaagccaaaggagccatactcttttagtctcatgctataccgtatattcacagaaaaagcattattatgcagcttgccagtctaaggattggttgctctgaaggtacaatactggacggtaaatatcatcaagaataagtaaaacattaacgagttgtatatttgccactttagacaaatatttctcgttcatataataaaaaaggtctgaaatggaaattactttgcagcaatttgaggcaatgtgccaaaatcgacaattacataatggttatgttgaaggtttagggtgtgtattttggcggtctcgctatgtcatatcatctgataccacatctactgaatcattttccacacctttctatgaattggtagtgataaaggatgagaaaaatatcgaaagtggattgcaaccattagaggggctgatagacaagggaactactgctttgtctttatatggtattgcaaattcttttgagcaattatcccaaaaacctattgtcattggagaaaagtatattcagataaacagacaaggtactttggttcgtaatcccaatagagtatatacaacaaaaggtgaagttgcgaaaggtgtaggtaggaaaatctatattgcagggcttgttattgatacagcgttatggatttctggtaaacagactttttccgaggcggcattaaatatgggagtgaacacgggcatttatattatcggttcttatttccctccagttggaattgctcttggtattttgtggttcataaccagtgtctcaaaacgtccatatatttccccaccaagttatgaagaaatacatggcactattactcccgcagatgcaacaagagttgaacgtccttattattgtgaaccaatgagagtcaggcccaatcataaaaaacatatattaagacaaggaaaatgataccataacacaatgaatataaaacgtaatacatcctctttcaaagaaaaaaatggagtttcatttttcgataatatattttattggatttggactactgtaccgtcaaagggatttcctgaccgttcttttgtagttgttacggtatgtcaattttcttatgtgttgctttttgtttctattttgttgactctatttgatgaccaagttcaactttgcatatatgacaaaccagaacctatagctattcccatgcttatattgttgataatattatcttttatcaatttaaaaatatatgatgagcaaaaatatcaaaaattggaacatgactttagactgatgtctgttccacaaagaaaaaaacataaaaatattttttttcttttcttgttgactaccatattagttatattagttgatataatgcttctttattcttataattctcatatgaataatctaacatgaagttttcttcgtgtagttagtgctcttttttcaaattggagatttttcccataatatagcaataaataaacaatttaatacgtctattatttcagaaaatgacagtgaaataatcatcaattccaaaaaacaaaaaaaatatgaagatgataagaagagtttttgcagttttatcggcagtgttttgtttggtaagttgtaataatgaatctaaacgaatgcccatttatgttgagccgtggtataattctgaacctttgacaattcaagtggggaagtttagcgatgtgctgaaaagtgaagatgtaaaaaaactgcaaagcacggctgatgtaattcgagccgaaatagataatactcccattgaaacgctctatgtattggcgattagattttatgatttagggcaaaaagatgatgccgtttattggttttatacagcacagttccgccgaaatctttacgcccgtatgatagaaaatgtagggggtgtaggagaacctgcatttgaatgtcgtcaggcgcaattggcattcaataaactatccgggaaatggattaacggttatgcaggtggtgtaccggataaatggcttgaaattcttgctcaagttattaatgaaggtcgcaaaagcggctatgtcggattggcttatcctaaacttacctttaagccagaaacagaacaagctgcggtagccgaagatatagcaaaagaattatctgaactgcgacaatatattatagataatcgggaagaaatggcacaagcccgtaaagaaaatggaatagaagggaaatattgattgaatctgaaaataggatatagataaacgaccataagatgaatataaactggtgaataataattcctattgttcttttattaatttatgctttagaattggctaataaattaatgaagatgaatatggaaaaagcaatcatggttgtagtcagcttattactttatatatcagcatgttgtgccaatgtgtttgctgacagtgatagaaatcccggatgggcatatttgctcggaggatggattgaaatctttttggtaaaatggccttcaaaacttttttatatggcatggctggctaatatcacttatggattttctattaatatgtacttgtcggggaagaacacttcattattatatgtacttattatagtcagtatattattggctatgcttccgttgttttttaataatccgacattcgtagacccggaacggggcattgaaagcactcttggagtttttcatttatcaataggttattatctttggataggtagctttttgactttgttattaggtgaaatcgtattgtttttccaaaaataaaatgaatagatttttaactatatatgtctttttgctattgtgtggcacggcttccgcacaacaaataatagaatggaataatttacagactataacggataacgcacggcgcacggtctattatgaaaaaggcagtaaacaaccgttgcagggagaataccgcattgtacgagggcttgacgaggagcgtgttaaactttccgatggcataataaacggcgattattttcgctatcgtgatggggtactgcgtgaatcgggcatatatgccaaaggtaagcgtaacggcacattcacggagtattaccaagacggcgttactctccgaaaggaaacacccatgcagcaaggcaagatagacggaactgtaaagacctattttcgtaacggcaaaatagaaactgaaaaggagtatagacagagtgtggaaagcggacgggaacgccgctttgacagcaagacgggtgagcagatttttgaatctcattatatagacggcaaaaaagagggtgaggaatgggaaatcttcgagaatgggcgcacgcttcgtagcaggactacacgacactaccgtaacggaaaacttgacggctcttatcgtgtggaatcaacacgggacggaaaaccctatataaccatcgagggacaatacaccgacggcgagaaatcgggacgttggaaacagtacaacgccaccgatgacacaacccatgaatgggatgaatgattttcttttttcgcaagttgattttataaaattgccgtaaccattctattttccgccttgacataagttgttagccgacatatctttgcgcggtcgagaataacgaattttagcacttaaagaaaatgaacgaagaaatcaaagaatggcagacacaaagcgtgaagcacaaagtagcttacgtgttgatgatggacggtatcagtttcagatacactgaagagaccgggattgtgttttccgcacctgatttttatgtaaagaatcttattcggcgcttgatgagctgctacggcgtgagtttgaaaccgattataaacgaatttaaataagtgagattatggaaaataagaaaatggattgctgggattttgtattcagttttgtgaagaaccatatagacgctttggtacaacaagctgacaagtacaccaaagagatgaacgaggactatgaacacttcttttgctggtatgctgaagagatgtacaaaacacaacgagagcttgcttgttaccgcgctttgaaaacggttttatccgttggcagtcatgaggaagcaaagttgtttatagaaaacaagataagcagtttgactgacagtcttctttccggaagcattcgcaggaacagtaccagtgcagcttcaaatctggcgcatacattagaactggagatgaagcagtctgtacgtgagaagtttataatgcttcttgaagttatagagaaaggtgaaagtgttgaaggataacggaaaaccgagcgtgacaacccggaaggcgtcaagagacgggtggcggtgtggaaagacacacgggagtgtatggttcttgcgccagggttcgattccctggactccctcagatatagacactaaaatgagtgacttatgaaaagaacaatcaattccacggagaagggtaaagatgtcggtatttctccggcagaagaaacacccataccgggcttcccaactgactatgagcaaagagtccgcgaacggctttctcgaacaccttttgcgtcattagtgaatgctttgagaagtggaaccagacaagatcagctgtcgtgtatgctccaagtcgagcgccggcttctgcaatatcgtcaggtagcgttatgttgtcgatacacacgcagtcaatttcttgaagagatgcaatcgctgtcagggctgtttggattagaggtctgctcttcgctgatgagagagtatcagcgtaagataccaagaaaggcagtgatgtcggattttgaggcataagtcggttattttttttaaacgcaacaaatataacgaattaggatattaaaatcaagtgagatatgaagaagtatattcatgtaacaagtgaggatcgccagtttttggccaaggctttcaacgtaagcagcgtgacggtttggaaagccctgcgttttgaacaggatacggataccatccgtaggatccagaaggccgcccgtgagcgtggtggtattgtaatggcggtggctccggttatggagacactacacgaccatgataacgtgatacgccaatattttccgaacggcgcattgttagagatcagtaaaaacgacagcacgggtgtggtgacttataaaggggaagaggtgagacattatgataatgtgacattttccaatatagacagcatccaaaattttgcggccgcattgaaataaggaggtgtgagtatggaatttttcgataacaaactttgcatatcgtttcgtgaacttgttgatggcggaataatgactgttccgaattacaagtatatggcatccagtggccggataaaggtagcacgtcgtggtggtggagcgaaaggaaatggagctttgattgttattgatagtctgcctacctcttacaaagaaaaagtcgaggagaaatatcttggtggcaatgccgtgcttttgcgtggctggataatatcgaattacgagcttgatcaggctgccgtcgctttctttatggattgggctgcccggcagtccagcgataaggcttctgacgagcttgccagaaagtatgcgataaatgcttcagtactgaatacttgtatcaagttgtacaatcgtagtcgtgattatcgaaagttaatgggagagaagtatgattggagcatgatggctactaccattgagacgctgcgcgaagagttcgggcatgatctgccggcgagtaccttgcgtttccgaaagaaggtgaacgagtacaagcagtacggttatgagtgccttatcagtggaaagttcggtaaccagtgcgcgaggaaagtggattacaagaccgagcgtctcgtgctgagcatcacggtgctgccgaaccagccttatggcagtgacgtacacgagatgtatatctcctttgtgtgtggtgagttggaggtatgggatttggaaaccggggaaatattcaaccataacgattttacggataagaacggtgatccgaaagaactgagcgaaagtaccattcgcaacatcttgaacaagccggccaaccaggtactcatagagaaaaaacgtcgtgggtggtcggaattctaccacgagcaaatgccacacatgcaccgccacagtggagagttctccttgtcccagattacgatggatgacgtggatcttccgcgtcgcatgaagggtggtgaatacgtacatgcttattatgcctacgatgtggtaagccagtgccgtgtggggcttgcttacggccgtgataaagacgaagcccttgtggttgcctgtttccgggatatgttccgcctgattgagcgtaacgggtgggggatgcctgccggtatcgaggtggagcagcatttgatgagcaagtacaaggagggcttcctgaaagccggtgaggtgttcaagtttgtgcgtttttgtgcaccgttgaactctcaggacaaatatgccgaaccgttgaacggcgcattcaagacaactatcgcccataagaaccatgaaggggtgggtcgttggtacggtaaaggggcacggcgtgtggatcagaagaaaatcagcgacagtgggaaccatacttacgaggatcggaaatattatacgtttgaggaacttgtggccgatgaccgccgggactgtgcggagtggaacaacacgctgcaccccaaccagaagaaatatccgggcatgacccgctgggacgtgcttgtggcgaggatcaacccgactctgcgcccgcttgacaaactgaccctgagccgttatatcggcgagagggtggaaacaagcgtgagacggaacagtacggtacgtgtggcgtacgctgactggtggctgagcggtccggaggttcttgagaagttggagcctaataaccgcaaggtgacggctttctatttgccggatgaggaaggcaaaccgaccgatgtgttcctgtatcagaatgaccgctatatcgacaaggtgcgcccggttgtgacttatagccgtgtaatggcggaacagaccgaagaagataaggcagcttatacggaacaggcaaagataatgagtcactttgacaaatgggtacgtgataacgctatcggtcaggtaggtgtggcaccggtccaacgtgaggaagaagatgaggaaacggaaagccttgtattacctacggcacctgttcctgaagaacccgatgaagcttacgaatggcagccgaccaatatggcggcaatggctattggagatatgtaagaatacgattagaataacattataacagcgtttgaattatgattacagaagcgcaaaaacagaagattttgggagcggtagccgccaaccgtgcgaactatccgagtgacgccaaacacgccgcttcccttggcatcagcacatcggtgtacagtgccattaagaacggacagacggataaagcccttagtgatgccaactggataagtatagcccgtcgtttgggtgtgggcctctgtgccgatatggagtggaaggttgccaagaccgccacgttcgagtatataaccgcccagctggagttctcccagcagtcgagcctgtcggctatcctatgcgacattccaaacatcggaaagacttttaccgcaaggtattatgtgcagaaccacaagaatgccgtgtatatcgactgctcgcaggtgaagactaagctgaagctggtgcgtaagatagctgcggagttcggagtggatgccaaaggtaaatatagcgatgtatacgaggatttgacttattacctccgttccattgagaatccgcttattattttggacgaggccggggatttgcagtatgaggcgttccttgagctgaaggctttgtggaatgccaccgaacgcagttgtgcctggtatatgatgggtgcggatggtttgaaagaaaagatcaaccgttcgatagaatgtaagaaagtgggctataccgagatgttgagccgttatggagaccgttacagcaaggtgacacctgatgacggcaaggagcgtgaggcgtttttgaatgcccaagctcggacggtggctaaagtaaatgccccggcaggtgcggatatagcgcagattgtacgcaagacacgtggaggtctgaggcgagtatataccgagatagagaaacttaaaatggcataggaaatggttaagatagttttagaggacaaaggccaagacctgttatggctcaaagtaaatgaaggtggtcttgtggaggaagccggaccatttcaaaatgaaatatggaaagatgcttatgtcccgtattgggggctttacgtagggcaattctgcccgatacaccatcctccgcatatcatcaaagggtttctgaaatataggattgaatcaatagaaaaagagccatgaaacgagcatatagtccgaaagacatagccgccaagaaatgggtgacgttgccgtggggcgagaaatggaacaagcctttcgggttccctgcggagaatgcctcctggttcatcagcggtgccagtgccagcggaaagagcagctttgtgatgcagcttagcaaggaactgtgcaaatacggccttgtgttgtacttgagttatgaagagggcgtgaaccagacattccaacgccgtatggaatatttgaagatgaacgaggtgcaaggtaagttccgtgtggttgtggacgagacctatgaggaactgatagaccgattgaagaggccgaagtccccgaagtttatcatcgtggattcgtatcaggtgtcggaatgggagtatccggatgcggtagccttgatgaagcgtttcccgaaaaagtgcttcatctggatcagccaggaaaagaagagccagccgatgggaggcggtgcgatccgtttgcgttatatctgcgacatgaagatccgggtggtcggttataaggcgtattgtcaaggccgtgccatcggtgaggccggcagctattatgtggtgtgggaagaaggaatcattcaaacgagtaataatttgtgatatggaaaaagacaaggtttacatcagcggggcaatagcccactataacattgacgagcgcaagggtgcgtttgccaatgcggaacagaatttgagaaatatgggcttttccccggtcaatccttttaagaacgggctaccggatgaggcccattggagagagcacatgcgggcggatatcgccctgcttctggattgtgagtatatctatatgctgaaggactgggaactgagtaaaggcgcgaagctggaacttgacgtggcgagttcatgcggcattaaagtattgtttgaataacagtttaaaatatagaattatgaatgacattgaaaaagcatttcgaggattgggtagaaccaagaaggtggagtttatctctgaaaaaattgattatgcatcggcacatgccgttgcagggtatgtgtcaagttatctttttgatgtgctgaatgaccttggcaatgatgattatgtggcaacgtatcttaaagaaaaaggatatgaagtaacgaagaaagaaaacaataaatgataggaactatggaagaaaaacagaaagttcaggtcgtatttgagtttgatcgttccgagtatgatgcgtatctctttttgatgaaccaaaagaagacggaagaggtagagcaagtatggaatgccatgagcggtgagcctgtggttgcggatattgatttgcttgaggaggacagtcagtctgtaaaacttatgatgataagtctggctatcctttcggtggagaaaaaagtgaaaggatgatatggcacaggaagtaaccaatttcgcccggttttacgctttgttcaacaagctgccgttcaacggagaccgggaagagttcaagaagtccatcgtgttgcagtatacatggaaccggacagacagtcttcgtgaaatgacgaggcttgaatataagacctgttgtgagggattggagaaattggccggtgtggacgagcgtcgtcagaagatgcaggaggaacttaaatattggcgcagcgtgtgtttgagactcatgcaaaaaatgggaatcgacacttcggactgggcgcgtgtcaatgacttctgccggaatccccggattgcgggaaaggcgttcagtcaaatctcttcggacgaactggaacaactggctgtaaagctgcgctctatccggcgcaagggcgggctcaaggaaaaaaagaaagaggaagtaaaacaaccggcggcggtgacctatatgctcatagacaccaaagcccctaaaaattgacggatatggataagagatttaatgaactgcttgagaatgtcaagaaccagatacttgacgtgttcccggaaatggaccgggatgatcgggaagagtttttcaacaggctgaacgagtggtcttatgagaaatatgaggaagccctgttggaaagcgagttggaaacgccagattatggtgaggagtatgagaattgatggattaacaacaaaaacgatttgaattatggaagagaagaaccagaccgtcgtaatgacggaaaccgagaaggcggagtttgatgccttccgtcaggcgaaagccaagaaagtcgcggaagagaaggcgagagccgaccgcgagatgtataagcagatggtggacgaggagatcgaacgctctattccggtgttgctgggtatcagcgagcgcatcaaggagagcaagcggacggtgatggagaatttcaagaccatccttgaaatgaagtccgacctgttcaagacgaaagcaaaggacgatcagcgcagtcacacattcaccaacagcgagggaagcaagcgtatcacgttgggcgtgtatgtgacagacggttaccgcgatacggtggaggacggaattgccatcgtgaaggagtatatcgaaagcctcgccaaggacgaaaagaccaaggcgctggtgagcatggttctccgcctgttggcacgtgatgccaaaggtacgttgaaagcctcgcgcatcgttcaattgcgcaaggtagcgatggaaaccggtgacgagcgtttcatggaaggcgtgcgcatcatcgaggagagttaccagccggaggtgagcaagcagttcatcagagctgagataagagacaataacgggatgtggaagcccatcccgttgggtatgacagaatcctaaaaatgaagagtatgatacagaatgtagagaagagccccaaagtagccttgtgccgtgcttgtcgcggcacgggtgtcgtacagagaacgaccgaacttccttcccggattttcagaaaaaagaaagtgaatattaccgaggaggcttgtccccagtgtggcggcagcggccgggtgatagtgagcgcgaagatggaactggatattcaaccatataatccaaagaaggagtaagcgatggcaaagcgacgcggagtaagttatgagaaacgtgtggaggagataaacaggatatacgaccaatatgccaaacgcggtgtaccgaaccgcgagatctggcggcggtacgtatatcctgtatatgccgttaccgaacgtacattctacaatatactcaacgcgagcgcggatgcgagcaagaagatagctgacgaggagacccgccagcttttactctttaatgacgatgactatgaacaaggacgtgcagaagataatcgcccggatcctgcaggatatccgggtggagatgacagatgagttcgaccgtaattttgagcgtcaggcttttttctccgaggcatggcagcggcgtaaaagcccgacacgtcccggaggttctattttgatagataccggccggctcaggcggagcgtttccagccggaccacggagaacagcatcacgttttacaccgacctttcgtatgcggccattcacaatgacggcggggagataagggtgacaaaaaagatgaagcgttacttttggcataaatactacgaggcgaccggttctttcgggcgcaggaagaatggagagaaacgcaaggacaaacgtaccgtgcagctgaccggcgaggcggagttctggaagttcatggcgttgaaaaaggagggcagcatgatcaagattccccgaaggcgtttcttgggggtttctcccgaagtggagaaggctgtccgtgaaatcatagaggaaaatataacggaatatttcaatgttgaatttgacataagacggaaatgagaaaggaactttataatatgctctgcaaggagctgaaggaggtgggcggaggcttgataaaacacatcgacctgtggaaccacaatgtggagtttatcgagcaggaggagaattgggaacgccctgccgtattcgtggagttctgcccgatacgctggaacgcgattgtggacggggtggaatatcgggccgaaccggaagtgaaactgcatatcgtgacggactgggccggtgcagccaacgagggcagtccgttcaaggaagaggcgttggaggtgtttgacctgccggaactgatacatgagcggctctcgtgcatggatggcgatactttcatggcatttgaccttgtggagagccagacgaaccacaaccacgaggagatcgtggaaaatatcgaggtgtattcgtgcgtggccttcaaacggcttcgataaacggccatgttcggacagtaaagcctccggcggacaaattaccgccggaggctttctatttcaacagggggcaaagaaacgccgtcaggcagcctcttttttgaacagcatcatgtccgtgtaggatgagctgtagtttatgtgggcgttgaactccatccgggtacatccctcgaacgggttgccgatatttttgtttttcccgatccattcgcacagctccaggatggaggatttgtttgaggtgaaatagacgaacggatgcccggatagcacgttcagcacgtcgaggtaatccgacatacgccaactcatattgtaagtacccacgtcggtggaaaggtacggcgggtccaccaggaacaccacgcccggcgtgtttttgtaccggttgaacagctccttgtaatcgcaggagacgatttccagcccctccagataatccgtgcactccggatagtccgctttccggatgttgttataaagggcttccttccgcatctccggtacgctcagtttatatttcatggagaacatcaaagaggaggacagggtgatgaagtccacgtaaccggtctcgtgctcctcttggaggatacggctgaagatgcgctcacgcagttctccggttatggtcttgtgccgtggaacggaattccctaccatggcacgcaggtcggcgatcagccggtttgtccttgggatgttttccaaccgcttgtggtaattgtcgaaatcgttgtatatgaccgtggcttccggcttgcatcgtttggtgatgtgtgataacaggccggaaccgccgaaaaggtcaacgaataccgtgctttccggatattgttccaatactttcataaacttgcgtgcgaacatgcgcttttggcccacgaatggcagcggggctgacagatacgtctttttcatacgttcaattcgaattttacgttaggatttccggcaagcagttcttgtgtgcgtgtgacgttgttctcgtaaatatgcacgttgccgaggttgattgtgatggatttcaggggtagttctatttgccgggatataaggtacaggtgatagatgtccgccggtaatccgaggttggcgtccgagctacgctggtaggccgtcaggaccagttcgccttgttcgatctggaactgtacgaggctgaggcatggtgcctggttgctttccgtgccggtcgaaccgaggaacagcacgtagttcttgctgcttcgtttttcccggttgattttgccaatcagaggtggcagcttctcgaaataggtagggtaggagttcacgaggatggagccgcagtagtcccaccagtttatcccggcttcccggtatttctcaacctgtctttccccgctcatgaagagcgacagttcgcttctgagcttcttccgtgcgatattgtgtccctcgaaaatatcgagcagttccgcaggggacagcgttaccgtctcgttcagcaggtaacggctttcacctttcctgcctttttgtgtcttgccgtcggcaagtaccttttttaggatttgataatacttgttcatggtgtgttgttttgataccccgcaaaggtaccgcgccgttatccctcttcaatggggaggctgtcccattacactgcaaacgggttacagtcgctttgcagccgtttgatgagcgtgtatacctttcgctcgcaaacattataacgttcggccagtactgccacgatgtaggaaaccttttcgccttcgtccaacagcctgttgtagtcattgtatagttcgatatactgtacgtcttccatccggattcctactttccggcatgttttcagcattcctttattcaatttcagtatctcaattactttcatattcaacaaaaattagtacttttgcactgtctcacttattaaacaacaacgaaaacacccaaatggggtggcatgagggcattgcccccggccgcgctccatttgggtgcgttgtgtttaatagtaagtgagacgactgaattaacaggccgggggctttttttacagccttacccccgaaggctttttttaatctaccgcatatagcgacaaatcaaatacatctttctttttccatccgtcggccagcgtgttttggatatgctgcatggctttcgtatagaagtctgtcaggtcttccagtgtagcaaactcgcgatagaccggttcggtgtccgtcccgaatttgaacacgaccggaagagtcgcccctgctgtttgcacggcaaggtcgtaggccgccttgtagttgaactggttctcgcttgacagccataccgggacattctcgtaggtgaaacctgataggatatccttgtcagtttcccggttgtgccatgttatgaccgtggagcgtatctcgtcttcggtgggtcgatggtcgaactcctcttccatgtaggtggccgatccgttctctcccggctgcacgtcccatcggacacgccatttgtttttaatggggtttatgcattcaagcaaccgtaccccgatgtttccttccacttttttcatcagctgaatacatacttggttctacctttgccgaaagtttccgtccggatgatggtctcaaacggaaatccgtccggcatttcactcacttgcgcgaggatgttcttcatctcttccgagttggtgaagaacttcttggcctcgccattcatctcgatggctacgatacagcggtcttcgccctgttcggtgcggatgccggtctcgaagtccttcacgatgatgggtaagttcactaattcccggatgcttaccacggagccgggaaaacgtttcttgccgtcttccggcttgtaggaaacgttcaagtctttaaatgatctcatttttttgcctgttaatttattaaacaacatattgcagtcggcgtgcttggccatcccatagaaggaagcgaccagttcacgccttcttttcctcgatttgacctcgtgcatttttcgggcgaatttctgtttgatgcgcttgcgtaggcgcacatggtcggggtatatgacatatcccaagaagtctatgccctcgtccaccgggaatacacgttcatcaggctttacggtaagcccgatttgtgcgacctggaagtggacggcatcacgaatcttccacaattctgatttcgcgtcaccgagtaccacgccgtcatcgcaatagcggtagaaatggcggacgccgtacttgtccttcaaataatggtctaaaaaaacagacaggagcaggttgcccaacccttgcgacgacctcagcccgatgctgattccttgcggcatgagccttacgaagttgtcaagcatggcgatgagtttcttgtctttgaataccctccggacgcaatacattacgaaatcctgccccacgctctcatagaacttggagatgtcgaatttgtagcagtagcgtgttccttccgggtcttctttcatgtcgcggcgtatgtactccatgaggtcgtgcatgccgcggttcttgatgctggctgaggtggtacggatgaaccgtttcttcaggtgcctgtccactacggccatgattgcgtggacggcgatgcggtccttcatggtgagtatctggatacgtcgcatttttccaccctccacgatttccctctcccggtaatccttgacggtgaatgtacccgtcttgatttttccggtaagttcctgaagcacctcttccctgtgcgcaagcaggtaacgtccttggcggcttttttttcgtttggagccacggaggacctggttgaacgattccgccatattggaataatcggcaatctcttccactatatatccttgcctgtgcattatagcatcgttttttttgattgttttacaaacggaagataagggccttcctttccccgggtctgacttcttcgagctgacttgagcctaccaaactccacccgacgcgtgatttttcagctttccgcacctgtgcgcttttgctgtggcttgcttccctcggcaccacggtaggggacacgtccccggtgttgtacgccgattgttagatttccagacgggagccgacattcgtgttcgagttcgatgcatcgttattcgcattcgcattcgacacgccgccattcgcattcgcattgttgtacccgcgatagaccacacggactatcaggaagctccaccggggtgcaaaggtacggataaaagccagtccccttgttagataacgaggaaaatcaatgcggcgattgctcctccggtcacggtgagtgtccagtccgtccagtcccaacgaccgccccggagcttgtctttgagctccagcgaggaggctgcgatggcggctgcgtataaggccgcgtacggtgtcagggctggcagccccacgataaaaccgcctaccaggtgtttgtagcggttgctttgtttcaaaaatgaaagaatcttgttcataagcaattggattaaaaaatgttttgtatatttgcaaacacagaagcattgagggaatgacgagcaggcgttttagtccaaagtgtcgcccttggtgcttttgttttttttattctactattatatcatttactgagtataaaaagtattttatgcggatataaccgttatcccttcttgttacttctttggcaacattaagccttacccattttccattgattttaactttgaagtagaagaagtgttccacgttgtccgtccttgggtgagtcaatgcggaatcatccacatattcggcacgttcaaggtgtgaatccaggttcttcaagtcctccttggaaacgatgcgtgtccgtccgaatgtgtcggagaacaagtgcttgttgccctctttggtaaagccgatattcaagtccttgccatttatgttcttttccactttcttttgaagtagaggctccatttcatgcagataatggatacgttcgatagctcgtgcggacttttcccggtctccggcgcatttttgcagtattttgcaggcggcgcacagctcgttgtccggaacgaaggccagtttaagtttccctttggccatatcacaatccctgcaccttttgatggtgtatgggttgtaatccggcatggtcttctgttcttttcccgggttgaaccggaagatgcctttggtgtccctttgaagggctgactcgcccaatgccattgcctcatcgtagggcgtttccggatatttggattttcgtacctggactacggtgcacctgcagttccatccatttggcgggaaatactcttcccaaaaggggtctgccataggtcgtgttaccccatgcagttcggcatgttccgggcgaaccttgccatccccggccgtccggtactggaggttgtagcggtccccgtcttctgcgaaccgttcccacttggcggccatagtcgccgaagcctgcacaaagttgtactctgcccggaggtagccccgattataggtttcgtctatcttccggacatcgttcaaaaagcgttcgaacgtttttcgattgccgttctcatccagcagggaggggaaggcttcgttcagttcatggaacgtctttaggcctgagaatatataatccgacctctgcaggcgccctcgcatggcctcggacatctccacctgccggaatgaagagtccaggacggaggcgtgcgtctctataaagtcctgcgcctcttctgaagccagtatgttgatttcaaggtttgccccctgctcccggaacagggctttcatcatgcggtcgaacatctctgtaagcttgtcacgcatcaattttgcctcgtcctcttttgagagttggagggtatgattgccaagcaatgaactgtagcgtagatgcagccccgaataatcctcggggctcagtcgaaaaaacgggatagcgttccagcctgtttgtcgtctttcttctttttcggatctgccgggtccggctcttccttcggttccttctcctcgcacggaatgccgtatttttcctcaaagtactgtggcttcaccttgtagtgctgcagtaccatttcttcgtaggctttctgctgttcgggagtgtagtcaatggagtagtcccaatcaaaacgcagtcccttgacaggaaaaccgtgacgaaccatgcgcggaatgagttggttgttcactatatcccgcagcatgtcgcagtcactttccacgaggttctggaacacttcaaggtgcgtttcagactgtgagaggctgcttccgtcctcaatggtcatcgtttgtccgatgataagctttgacagttcggaattggcccgatcgatgcgcttgtcatagacattgaatgcatctcccttgccgctttccacaaattcgatttcggtttccattcctgccaccatggagagagcggttccggcttcacgcagcatcttgtcaaggcggtcgatttctttctggtcgcgcgaggtggtgcgtgctatacgcatgggcattccgaatatttccccgaaggtatcccaaaaagccagcatattctttttggggatagtctgtgaagctgccttgagatacagcccgaggtcgtcaggtctgccggcctcaatgagccagtccgaaaaaggcggctggcggtagtctatacctgtagtccagtcctgtccgaggtcggttatgacacgcccatattcaggaatgacatgcttacgcggaataagcttcacatccgaataacagatgcagccgtcgccgtcagtgcaaaggtcgcccaattcgatgagcgaatgtccccagtagatggaatcgagcgcatatcgcatgagctgtttgaaccaggattggtcgaagaagtgtaccgcctcctcgttctcatcccctttcacgtctacgattttgaaagagcgtgccatgacaaaccctctgcgctgctccacgcatccggagaggtgaagatctatttccgcgtcccggtagatgtcgtacaggcgctggcggctggggctgtccacattgatggccgactgccaggcatcgcgccagttcttgatgtccttccgggtgagtgcatcggtggtgcgctgcaggtcgatgaccattttctgcacccgcttgatgtctttccccttggccagattaaaattgccgtatggcgtttgcagtacgtttttcggtttactggaaaacataccgctgaaaaagtctttaatatccatagtcctaccaattatgatgaagctgcttctgacagctgtaaacaagtgaatttccggacggaagcccatcttctccgacagccaagggcaaatcagggacaatttttccggcctgtacgccttcaagccacttgatggcccgttcatatcgttccttgcgtatctcgcttcccatcttttgtggcatggctgcgctcatgtggtaaagtgaaatgtcgcaggtgtacatgacaatgagccggttccggtgttcatcctgtgcagagaaaatggccgtacagtcgtatttcggccgtagataaccggcaatttcttcccgggcttccgcttctgcattggtacggttttccgggcttacctgggagatgaccttcaatgcgttgtcgccgatgacaactttgtaatcttcttctgtaatgaacatgaccttattatttagtgatgaataatgccattttttctatatcccggatagtggttcccttgcggaaacggtggcggtgaatcagttcgcagatattccttttggggacaactttcagtttgccgcccatatacaggacgtagtattttcttccgtagagcttggcatacttgcaagcacgggcaacggcacgtttatagcgccatgcaaaaatcattcttttaatcagttgtatcatgttaccatatatttttggcggtcggccttttgccgaacaccggttgaaaactctcctgtcttgaattgcgctgcagcatccagatggctccctcgtcggcatccggtgcatcatcgtgaatacggctgccacgctccagagccaaggtctgttcgattccggtctgcatatccggcgattctttcaacttctcattgtagaatacgaaaccgcgttcccataatggtgacaccgcttcgatgcgctggagcttgtccggcttctttcgtttgtccggcatgatgggcagttggtatccacgcagatttccttctgcctcaaactcatccagaatgacatcctgcatgaagttcgcttccataaagaactggacggctgccgtatcgcgtgtacgctcgtagaggtcgtaaagccaccgtaccattccggaaacggtatcctgccggacgtaacagtctataaggtgcagttccttcccaatcttgccccaaaggcggcaagccttgtagtcgtttgaagtggtcgatttgaaagaggggtcggtatagcagaccagcatttcatacttggacagtctgggcagtttcttgtaacgaatccagtctgcccggaagatagtgccgtccacgatggggttgtgcatcatctccttttcccatgcccggtagcctacgaaatccctgtattcctgcgcctcctcttttgtccatttttcgcgccataccggttctccgttcttgtctattgccttgatgacggatacatgtaccccttttgtcttggtgagattggccagcaccgagtttttagaaatgaggttcccgaccatgataaagcgtccccggcccacatccagtgcaccaaaaagggcttctttcacccagtctgtaatgtcatgcacccgtttctcattgcggcacagttcgtcgtcatccaagtcatcgatgacgatgtagtccgggcgtgcttcccggtcgcgcagaccacgcggagactgtccgcgtccgcaagccaggaatttcaccccgttggcagccttgaactccccatcctgccaggaggcattcccctgctgcttgccgaagtcggcaatgatgcgctggttgtgttccagttccgcctgaatatcgcccagcagacgtgtggcagagtcttcgcttttgccgaccaccaccatgaaattgatgagccgctttggttggaacatgagccataatgggacgaagatgtccatgtgagtggacttggcatgaccgcgcggccacatgaataccgccttcaggttgggcgtaccccttactttggccgctgccgcattgtggaacggtgcattgtgaatggtgcgtatggcttccccggtagtcttgtcacgcaaggtgaggaagtggggaaagtaatattcgcagaatgcggcatagttaccctgcagccgcagaatgcgcctgtccctttgtgccggtgtctcgcctgcgagcagcgccgtatccgtaatggactgtacccttttgcagtgttctttccactgttcgtatgcctgtttcttttccgctgctgttgccatgcccttgttattttatgcccatctgttcggttatgtacaggtcctggtacttgttgatggcctttaccaattccggggtcacatccgggtcgatcgtcgagcggtattcgatccatttggaaaatgccatgaacacttcgatggcatccaccacattggccttcttgtcgagcttctcgatgaccgccgacagttttgccagcttgtcgcccagcccggctatcaatgtggggtcatccgacgagttcacttgtgtgataagcgtgtcgatggtgagcagaagcttgttcaccagttccgggcgagtgacgttctttgccgcccttgcttctttccacccttcggaggtacaccatttggatatggtgacacgagacacgtccaccttttccgctatttccgtttgctccattccggagaggaatagtgagcgtgcgagcgatttcttcttttcgatttctgcctttgtcatattataaagaatataggtttgaacggcaggtattggaatgactgtacacctgcccgatttgttcgcaaagttgtccgcttatcggtttgccgccaaaataatgtgtaacggtttcatagaagtgtgcaaccgttgcacacatttttggcggccctgcgagtgctccgtaatattgcagagccaacgcacaaaggcgtggcatggaaaaatgagtaaacgtgtaagaatttcaaatgacagcctgaacagttacggaagccgcgtgctgacatcgggcatgagtgtggagcagtactgtcggaatccggtactgctgtacatgcaccagcgcggtagcgtgatcggttatgtgaaggatatccgggtggaagacggcgaggtgaccggtgaacccgtgtttgacgaggcgaccgacctcagtaagaggtgtaagaaacaatttgagttcggcagcctgagaatggtaagtgccggcatagatatcctggaactgagcgaacagcccgaacatctactgccgggacagacttgtccgaccgtgaccaagagtaaactgtacgaggtctctctggtggacgttggttctaacgatgatgccatcatattgatgaaagacggtaaacaaatcactttgggaagggacggggaatgtcccttgccatcaatcaataatcaaaaaacagaagaagaaatggaactgaaacttttggcccttcaattggggctgccggaaacggcgacggaggctgatgtaacccgggcattgaatgacctgaaagcggccaaggctgagaatgactctctgaaagatgaaaacgggaagctgaccctggcccgcattaccggtcttgtggaaaaggccgtagcggagaaacgactgggggaagacaagaaggcgcagtttatcgaactgggcaagaaggttggatccgacgagctgaagaatgtgcttgatgccatgcaaccccaggtgaagatctccaccgtgctgagttaccagggtggcaagcagcaggcacagccgtccacctatgccaagctgagcgatgtcccgagtgacgcactgcttgaaatgcgtgagcagaacccggaggagtacaagcgtctgtacaaggccgaatatggaatgacctgtgaaatttgaaaacctttaaaatgaagacaatgggaaaaattgtaatgcttttgacggcactcctgttcaatacgctgacaggtgccgtgtgtgcttccgtgctgggattctctcctgcagccggagctgtgggaatgaatgcggtggcagccttcatgggcatggctccgcagagcgcttcaatactccgtgaaggggtttatacggaaatctggacgggcgagcttgtcaaggtactccgtgccgggctggaaggcacgtggctgtcaggaattcccgaccaaagcagtatcgtgaacaacgatgtgattcatctggtagaggtaggggtggatccggacgtcttgattaacaacaagacctacccgattgacgtacaggctttggaagacaaggacatcgccatcaagcttgacaaattccagaccaaggccacgccgattacggatgacgaactttatgccatcagctatgacaagaccgcccgtgtaaaggaaggtcatgccaacagtatcaatgacgcgaagttcaccaaggcggcccatgccctttgcgcgaacaagaatacggcaacgaccccggtgcttaagactaccggcgagaaagatccggccacaaaccgtctgcgccttaccgtgaatgaccttgtggaaatgaagcgtgcccttgacaacctgcgcgtgccgtcagacggccgcagactggtgctttgccccgaccatgtgaatgacctgctgctgaccagccagacattccgcgagcagtacaacattgaccgcaacagcggcaaggtaggcaacctgtacggctttgaaatctatgagtacggcaacaatccgctttatactacagccggagcgaaaaaggcattgggtgcaacggcagaagccggtgaattcccgtgttcgtttgccttctacaaacagcgggttttcaaggcaacaggctctaccaagatgtattattccgagtcaaagaacgacccgttgaaccagcgtaacctgattaacttccgccattacttcatctgcatgcccaagaaagaggatgccggagtggtaatgatgagcggctatcaagcatgatgattatggcaaagttgaaatatctggtaatacactgtacggcaactccggagggacgtgaggtttcatctgcggacatccgcaaatggcatacatctccggttgcccagggaggaagaggatggaagcaggttggctataccgacctgttccacctgaacggaggcgtggaacgtctggtagaaaacaatgaggatgcacaggtggacccttgggaagtgaccaacggagccaagggatataacagtgtgagccgtcacatcgtgtatgccggaggcgtggaaaaagacggtaagaccccgaaagacacccgcaccggctgtcagaaaaaggcactggagaagtatgtgaaggattttcaccggaaatttcctgatgtacgcattgtaggacacaacgaactggcagcgaaagcctgtccgagtttcgatgtgcaggaatggttgaaagaaataggtattaatcaataataaaaccgggtggtatggacttgagcgaatttatgaacattatccttggcggcggcctggttggtacggtggcgaccattggctccttgcgggctactgtgagaaaagcgaaagcggaagcgatgaaggccgaggccggtgcagaggctatgcgcatagataacgccgaacatgccacccgcattttgatggagaatattgtaaaacctctgaaagatgaattttgtgaaacaaagaaagaactggcccgcaatacacgtgagatggcccgtcttagaaaagctattgatacagccgggaactgtcctcatcgtgacgattgccctgtgcttgacaggttgcgcgagtcaccgaaagagcatgaaccgggaagtccggacggaaacggcaagcgccgacagcgcgagcggaagtcgacgggcgggactggtgatggcgggggtaccggcgagttcggtgaagctgactataccggcggacagcctccgtaaacttcctgaaggggcggtgtatcgcgggaagagtggacaggcgaatctgaccgtaggcagcgatgacagcgggaacatcgtggccgaagctttggagcgatgctgcagccgcggcttccgccggcggcagcttgtactgcccccactcgtccggtattgcttccgtatcgaacacgccgtaaggctgcgaaccgtcctccggcatcgccacttcgagcgtaacctctatcttggaggtttctgtaagggtcagcttgcctgcaggattggaaagcagcgtggcgttgggaatcagtacgctctgtccggacacgagggagagttcccatggtccctgcatgacaagcacctccgacggggctgtccagccgatcggagttttcttttccgagtcttctttcttataatgcaggctgccgccaagcagtttgtgcaggttcgaatagttcatctggatcacattgaacgtcggggcgatgccgccgttactctgtgggatgaccagcaccggggcaccctgcacctgttcggcctcgatcttcgcggcctcgggtttcttgccgcccaggtcaaacgagttcttttcaatatacccgattgtgaaatccttatactttacggctcctatgccgtacatgaaattcttgttcatcgtttataaagtttgatggttaataacacaccggccaataagccggccaatacacctgtgataaacgtccgcatccggttcggagggcgtttttctactgtttgaacgtcatttgaaatttcgctcttggtttcgctacggatgcgcgccagctcttcttcataccatagcaccagctgctgcagactgtcacacgaggcttcggccacgatgttcccgctgtcgtcgctgcctacggtcagattcgcctgtccgctcttgccacggtacacggcaccttcaggaagtttacggaggctgtccgcaggtatagacagcttcaccgaactcgccggtatacccgccatcaccagtcccgcccgtcggcttccgctcgcgctgtcggtgcttgccgattccgtctgtatcttctccaccgtcgtgctcttcctgctgcttgcgcagcccgccaagcacaggacagtcatcatgatggcggcaactgttggcagtgtcaatggccttgcgcagtcgcgccatttcgcgcttgttggcctgcaggtcttttcttgttgcattcagttcttcttttaagggtaccacaatattgctcaccaaaacgcgggtggcatgttctgcgttatccacacgcacaccctctgcgtcggcttcggctttcatcgcttccgctttcgctttcctcaccgtagcacgcagggaaccgatggctgctgcagtgcccacaaggccgccgctaagaataatgttcatgatctcgctaaagtccataccacccgttttttagtcagtcaaccttttattctgcgtcctcgcgtttctttcggaatagtccgataacccattgcaccagtcccgtgtcggctaccccattggctacaagtgaggcaccaaaaccatagagcaaggcaatgtcccagctcacatcactcacaaatccggcatcaagccaccacagtagcatcgcgcacaccaagcccacacaccagctcaccagctgcgtcacccagcctttcatgttggggaacaaacctttcaacccttcagtaagcaccaccacaccgccgacgaaaccggcaaaggtgccaatcattgcgtcatagtccgttgccggaacatcggccccttgggccatcacagccgatactgttcccagcatcagcatcataaacagcataattcgtttcattgattgcttcttttattattggttaatacctatttctttcagccatttctgtacatcgaaactggggcaggctttggccgccagctcgttgtgtcccacaatgcgcacatccgggaatctgcgatggaagtccttcacatacttctccagtgcctttttctggcagccggtgcgggtgtccttcggggtcttgccgtccttggccacaccgccggcatacacaatgtggcggctcacgctgttgtaccccttggctccgttggtcacttcccagggatccacctgcgcatcctcgttgttgttcaccaggcgttccactccgccgttcagatggaacaggtcggtatatccgacctgcttccagccgcggccgccctttgagacggggttcgtatgccaggcgcgaatctccgcaccgcttacctcacgcccttcaggagtggccgtgcaatggatgacaagatacttcagctttcccatcactcaccgccttcctcttcatcaacggccgcctgggacagtgctatctccaccttcttctccggatcggcgtccaggcccagtacaagtgtgccggataccgccttgccgctactgttcacaccggcggtgaccgtcagagagccatcggtaccgactgccgtgaaaccggcaggaatggaaaccacgctgtaatcaccggaggcagtgaccttcacctccttgctctcaccggcggccttgaaagaaagagcggccggatcggcagaaatgctgcgttccactaccttgaacaccggagtctcacgggtgtcaagcaccacgaactcctcgccgaaggcgatttccgtgtcggccttcataagcagcttgaagaagtacagctcgctggagttcatccacttgtcaatctggatcacctcctcatcgtcctggaggttcacaccggcaaaaaggttgccgtcagcgctcatcgagcagagcgtggctacgataaggccatcaggccaggaattcagcgtctcgatggtgatacccttgtaacgcttcttgttgatgtccgtctcgctcgtgttcttgtactcgcgttcggtcagctcgtcatcgtacttgtcgaagtcgtcaatactcatcaggatacgcaggttcggattctcacgcagggcttttggaatagccttgcggacagccttcaacttgccgatcatggaagtatcggaaggagccggaaccacgatcacatccggatctttagccgcctgggtcaggataccgttgaaaaggtggtcgtcgtccgaaccgaactcgccgttcaggtaatgccagcccagctcgaacttcacactcttgctaagttcatccagaagcgtgttctgcgcttcggggggaagttcggcaaacacgaggttgcccttcggctgccacttgcgccaaacatgctcgaaggcacggggattgaaagtcgtgaacgccatgaagtcctccggatccagtgatttctccgagtaattgaaattgcctttcgagtcttccaaagtcgggttctccttacgcttctggagcatcttgcccgtcttgatacgcggcaggctgatttttttctccacaccggggatcaccatgatcagacctttttctacaaggtcattcccggtggtggccaggaccagtattttctccagtacctcgccgttgtaattcgtgtttcttactactattgccatggcaaatgtttttatttatggttcaacttgtccttaatctcgctcatgcgcttgttccaggggctttcacccgtcggattcacacgaaggtcggtcatgacactacgtttgggggaaagcttctccaatgccttttccccgttctcccggtcttttgccagaaggttctcatagatggggcgggtggcggcatcgatacggccgtcctgttccgcatcatcaagcagtttcttacgcgcggcagcgtcatccgcatccgccttgtcctggaacaccttcagttcgcccttcaggcgggtgacctcggcatcaagggccgggactttgccagcctccgtttccagcagtccgatttcacgcaggaaatcgtcatccgtcgcacagttcttgaaccgcggacgtctcttgagttcgtctaaattcatgctattctcgttttgtggcttgtgcagccggttattgaatatttgaaatacttgttcgggggtactgtcctccggtaccgggtcagcgtcataaataccgtcgataagccccagcgccagcgcctcgtcggcacgcagccagtgatccttgccgtcaaaatacatcgcgcggatttcctccttgtccttgcccatacgggtggcatacatctcgcaaagggtatcctcaagcgcctcgatctcacggatgcagtccttcatctcatccttgttgccgtaacagccgccctggacactgtgaagcatcagacgggcataacggctcatctgcacgggcttgccgcaaagggcgatgacggaggccatgctggcggcgatgccgtctacgtagatggtaatgtcggccttgctgttcttcaaggcattgaaaatggcgatgcccgaataaacctcgccgccgttgctgttgatacgcacgtccaccttcccggtcagggcttccgcttccagaagttcacgggcaatatcaccgctgcgcacgttatcatcgtactcaccgatgtcaccgtaaagaaggatgcaacaggcatcggttccgggtatcatattgaaaaatctactcatgtcactatcgttttggcaggtccttccctgcaaagtttacggtgcgaaattagggggattaaaagcctttttcaaaccgcgttttcatcatggagactttaaaggattgccatgacgctttaaaatgtcatcatgcggagcgcgttttttttcgctccttttccttatcaattttgcacgtaaaaaaggaggtaatatggccgaacttacaaacgagcagaaaaaggcatgggcgaaaacgctctacacccgcgaaacgctcacgcaggcggaaatagccgagcgtgtgggggtttcacgggtgactgtgaacaactggataggcaaaggaaactgggagcagctgaaggcttccataaccatcacacgggaggagcagctgaagaacctgtaccggcagctggcggaactcaacaacgccatcatgggaaagccggaaggggaacggttcccgaacgccgcggaagcggacaccatttccaaactgtcgaacgccatcaagaaactggaaacagaagtggggctggcggacatcatctccgtgttctccgacctgctcaaatgggtgcggacctacgattccacgcaggcgaaggagatcaccccgcttctggacgcgtttgtcaaatcaaaattatcctgacatggcaaagaaaagactcacaccccaggacaggatcgcactggacaactggaacgagctggtggcatccgtgcgcgaacattcggacatcaaccccacggacacggaaacggaaatcaggcagaggcgggaaagactggagaagaacgacgaggagtggttcaaatactacttcgccatgtattgcacctgcgagtccgccgccttccacaaaaaagccaccgggcggctgatgaggaacaaccgctggtacgaggtaagggcctggtcacgcgagctggcgaaatccgcacgctccatgatggagatatccaaactggcactgacaaaaaagatacgcaacgtgctgctgatctccaactcggcagacaatgcggaaaggctactgctgccgttcatggcgaacttcgaggagaaccagcggatcatacaggactacggacagcagaaaaaaccgggagcgtgggaaaccggggagttcacctgcatgtccggatgctccttccgcgccatcggagccgggcagtcaccgcgcggtacgcgtaacaagaacttccggccggacttcattctggtggacgatatagacaccgacgaggagtgccggaatccggaacggatcaaaaccaaatggaaatggctggaggaggcgctgataccgaccatgtccgtatcgggaaactaccgcatcctgttcaacgggaacatcatcgcgccggactgctgcatcaaaagggccatcgaaaaggcaaccgaactgaaggcgaaaggaatcgggcacgtggatatcatcaacatccggggaaaggacgggctgtccgtatggcccgaaaagaactccgaggaggatatagacctcttcctctcactggtcagcgcggcggcggcacagaaagagttcttcaacaacccggtggtggacggcggcgtgttcgcggaaatcacctacgggaaagtgccggcactttccaagttcaagttcctggtgatatacggggaccccgcaccgggagagaacaagacgaaaaaaagttccaccaaaacggcgtgcctgctcgggaaactcgcgggaaggctttatctgataaaaacgttcctggacagggggctgaacgcggaatttgtagagtggtacatcaagctgctggagttcgtgggcgggaaaaccaccgtatactgttacatggagaacaacaaattacaggatccttttttccagcaggtattccagcccatcgtgcggcggatacgcagggaaaggaaaatatcactgtacatcgccggggacgaggagaagaagaccgacaaggccacacgtatcgaggcgaacctggaaccgctcaaccgggaggggaacctggtactcaacgaggccgaaaaggacaacccgcacatgaaacggatggcggaacagttcaagctgttcaacctgcaactgacctatccggcagacggacccgactgcgtggaggggggaaacagaattatagaccgcaaggccagacagtcggaaaagcccgtcattgtcacaaggaaaagcacgcggtcacaaaacaagtacagagtgtaaacttcaatacctatcattatgagcaaatttatcgaactttcagactacgacgcgagcatacaccgcgagattctggacgcactgacaagggaggacgacgccgtcgtggagatatgcgaggaccgcgccgtcgccgagatgcgctgctacctttccagacgttacgactgtgacaaaatattcacggcaaccggtgacaaacgcaaccagcttgtcctgatgatggccatcgacatagccgtgtaccacatcttctgcatacataacccgaggaacctgtcaccgctgcggaaggaacgccacgaaagggcggtcgaatggctgaaagccgtggcggccgaggagatatcggtggacggcctgcccctgctgtccgaagagacgagggcggcaaaatcaaatttccttatcaaaagcaaccgtaaacgtgtaaaccattggtaatatgaacaaaagaaagaaaggggccggaaagataacccaaagcgggaacctgccgaggcccgggcagaaaggacccgcaaccatcatactgacacagcccagaaggttcggtatagacatagcggactacatgctcgcggtaagggctttcgagaatgtggactactccagacgcttcaggctgtacgacctgttcagcgacatactcatggacacgcacctgacaagtgtcatagagaaacggaagaatgccgcactggcatcttccatagaattccgcaggaacgggaagccggacgagaaggtgaacaagcagatcaggtccccatggttccggaagttcataggggacatcctggacgccaaattctgggggttctcactcgtgcagttctaccgcaagggggaatgggtgaactacgacctgataccgcgcaaacacgtcgatcccgtgcgcaggctcatactgcggcaccagacggacaccaccgggacgtcctgggacgagtaccccgacctgttgttcatcggttcacccgacgatcccggactgctggtgaaagcagccatctgggtgatatacaaacgtaacgacgtggcggactgggcacagttcgcggaagtgttcggagcgcccatcagggagtacacgtatcccacggatgacgacgaggcacggcagagggcgctggacgacgcggacagcaccggaagcctgtcggttttcgtgcacgcggaggatacggtgctcaagctcgtggaagccgcgaacaagacagggagcgcggacctctacgacaagctctgcgagcgctgcaacaacgaaatctcaaagctgttcctcggaaacacgctcaccaccgaagcctccgacaagggcacacaggcactgggaaccgtacacaaggacgtggaggagaaagtgacgctctccgacaggcaggacatcctcgacgtgctcaactatgacatggccgacatattcgcaatgctcggaatagacaccacaggcggggagttctgctatccggaaaagaagcttatcgaaccggagaaaaagatgtccatcctcacacagctgcgtacgaacttcaacctgccggtaggtgacgactacctctacgaggaattcgggatcgagaaaccggcaaactatgacgagctgaagaaacgccaggaggagaaagcggcggaaatcgaggcagcgaaggcccgagagaccgaaaaggcggaagaggatgaaccggatccggaagaagaaccggaactggaaaagcacggtaaaggaacacccaaagaaaagaaaaatgcccttaaaaacgcatacaactggctgaaacgttttttcgggaaagccccggggagagacggggcagctttagaatggtgataaacgacctctacagaatggaggacaaacaggtggaaactttattctcgttcgatgaagaggtactgaagaaagccctgaagaacatatacagcaaagatttccatcccatgaccgacatcgaggagaacctgttcgaggccacgtggaaaacgatgaacaaagccaccgacaaggggtttgggacacggaaaaccgatgatccggattatgacttctaccgtgaaatccgaatgaacaacgccgtgttcgcagctttcaaggtacacagggcacagaacgacatggcagcgctgctgctggacaaaaacggaagtttaaagccgtttgaacagtgggtgaaggaagccatgcccatagccgaccaccagatgatccattggctgcgtacagaatacgacacggccgtcatacgggcacaccaggccgcggactggagacagttcgaaagggaaaaggatgtattgccgaacctcaaatggatgccgtccacaagtgtgacgccgggagccgaccaccagattttctgggggaccatacgtccgatagatgatccgttctggaacgagcacaggcccggagacagatggaactgcaagtgcacgctctcatcaacggatgaagcgccgacagcggtaccggacgaaaacgggcagaacaaggcacatgacggtctggaaaacaatccgggaaaagacggcaaactgttttcagacaaacacccctacattactgaagcgcatccgggagcaaaaaaagccgtggacgcactgaccaggcgcatcaacgaaatgatagccgaaatgccggacaacctgacgctggaggaaaaaaccgacatcgcccgcaacaatctcaagatagaaaaggcactcggcgttaccaaaggcaagccgatgacatacgaacaggcgaacaagggaaaggagaacccgaaattcggaaaagaggaaggataccgcgtgaattgccagacctgcaccgtgacacacatgctcagaaggttggggtttgacatcgaggcaaaacccaacatcagacaaagcgcatacaatgaaatggcaaaacaaggtatcacatgggaagaacgtttcctgaaccgggacggaacaaagccggattatgactatacctataaatggcaggtcagaaagggatatcaagtaatgaatgcaaaccggctgaaggaatacttcagggaaaaattcagagaggatggaatatacgagatatattgtgcctggaaaggcggctccgcacacgtgttctgcgcagaggtgactgaaggaaagacaaggttcttcgacccgcaaaccggaaaggatgatgcaagcaattacatacagagcatgaaagcgggccgtgtgggagtgataagaatagacaacaaactggtaaatcccaaaatcatgggactattcatcaccaaataaacgggaagaaagtgccagcccctcctcaccgtccaccagacggcaggactggccgtcgaacagaataaaggcgggaagaccgacaggcaactcaaaaccatccccgtcaacacagcccacggaatagatgcttccttcaggggaactggctgataagacaacggagttgtaaccgctactgtttgctaattccgacacttgtttaggtatttccataacgcaaaaaggcacataaaaaacgccttgctgcaaaagtataaaattattttttaattcagtcattcatggacataaaagaatattcaaaactgataaaagccaaacggaaagaactggatgggctaatgaaacggaaaatgccggttatcgctggacgaatggcaaaagaccatttccaggacaacttccgccgggaaggtttcgtaaacggaggattacacccgtggccgaaagcgaaaaggctgtcctcgggacggaccgatgcggcagggagctacgggacgctgctctccggaaggaaccatctcttcagctccgtcaaatacatgccgggagaataccgagtgagggtggcaaacgaactcgtctatgcgccggtcaataactggggaggagaagttcatccgactgttacgccccaaatgcggcgttttgcatgggcgaagtattaccaggcttcaggcaaggctaaaaaagccgccacgggcaaaagaaaaggcaaaaagaagggttctgccgcaaacaatgaaccgcaggaaaatcaggaagcgctgaaatggaaaaggctggcgctgaccaaaaagaaaaagctccggataaaaataccgcaacgccagtttatcggggaaagccgggaactgtccgaaaagatagaccgtaaaatggagaatgaaatcagaaatattttaaacttataacaacatggaagaaatttttatcgcgatcatggaacgcatcgccgaaaagatgcctgaactgtcatacattgacgaggactacggacagcttgaagccggggcggaggaggaccactatccggtaaccttcccctgcgtgcttgtcgggaacgccgaatcggactggaatgacctcggttacggggtacagaaaagcgagtcactcatcaccatacgactggccattgactgctacgatgacacccactacacctccggaacctatgacaaggtaagggaacggcagctgaaggccaaagagctgtacaaagccttgcaggagttccagtgcacggaagagaccagcccgctggtcagggtaaagagccgggactattcgctgccgggaaacatcaaggtgtacgagacggtttattctttcacgctgcatgacgagtcggccatgcagtaaggggaaggttcattcccccgtgaacagggaaagctggacggctgtcaggcggggtttcttaacctttgggacgggcttcacctccaagtccttcagctcccggcacttgcaccggataatggacatgatccgctcctcggaaatgaaaaactcctggcgggacaacactttcagggcatcatcaaaacgcaggcgctgcacctccgtccagtaatagtaacggcggcacagggcttcatcacggagttctatcagttttttgtctcgtcctttagccataagttcaggtatatgctgcaaaattaggcatttaaccggggatgttaataaaaaaacgccgcatcgtgtatgaatgcggcgtttttctgtttagagtgtgaacaaaatcacatggtcatcagttcggtgtcatcctcacccggaacaaacggctcgatgcgggtgatcaccttgctctgtaccttcacccgcccgctgccattacagaccggacattttgcggataaaggagctcctccctggtccaggtaaaagatacgtcccttgccttcacaacgcttgcaggccatgacgtgcggcgcgatgttcttcgtcttctccatgactacaaccggcagaatgagggttcgatacggtgccagacaccgttttcgtcacgtttgtggaaatagtagttcaccgcggtcttgtacaccacgttgctctcacggaagaggtccatgatctccgtgtactcgctgtcgaaacggtcctcgagctcgtacagcttactcacggacttgtagtccagatcgccctggcggttgcgctcgatcatggtcatgccgagctggtacatcgggtcgtcggtacccagctcgcgccccatggcgtagcgcttcaggtaatccaccaggcgttcggcggcaaggtcggcacgctcgtcgaaactcttcaccttgttgctcctcacctccagcttcatgtcaccgtccacgatggtgaagctcgcctgctcgtccttacgcagctggccgtattcacgcatcaccgcacggaaggcggcggcctctttctccacccagtcgcggaacgccttcacgtcatccacaaccgggagcagccggttcttcacttcaagcatgaactgcgcacggaggccctcataggcatcgcgccggttacgcttgctttccttctcttcctgctggagctgtttcaaaagctccttcctgtcctgggcggacaggctttttaattgttctttcaaatccatagctaaaaaattaaatggttgctattgttgtttattctcacgtttacggcggatggcacgcagcttcacctgcaacgtgtccaacgcctcacagtcaagttcacggaactccttgccggcgatacggctgtcccggcagaaggcgttcacccggtcccagtcggccgtatcgatacccagcagctgcatctggtgcagtaccgcggaacgcttctgacggagaatcttccggagctgttcctgataagtgggcggtaccagcttctgcatggcggacacggcggcactgtattccttcagtgtcatgtcacgcagactcgtggtacgtccctccgtgtactgggaaacgatgctttccttcagtgcgtcacgatccgatgtcggaaggcggttcaaaaggctgtaaaacgccgcataattctcgggtttatttaactgcttgcggctgttgatgtctatctgcatggctatactgtttttttgtttattttaaggtcattgatttccttaatcactctctttactctgatagtacacaaataatcaagaagatgctctttttcattttttgtacacttatactggtcgaaaaattcaagtatgcccattctattcagattttcattaactcaaactattcataccacatcagcacaactctatgatttcacccacggcagagcgtagaagagtacgcaaaaccgaagggtttccgctatcatagatgacttccacacaacactcatggcgtgcgttacgtgacacaaccagctcgcaagtcatattctcacagagccatttttccactactttacggacaccaactgcggtgaccacaattaccatttttttactcataatattgaccgtgctgtatgttattcaactcttatcctcccggtgtactggtttccccgaaacttcatccccttggtgaagccgcccggatatcccagttccttgcttctcgcgtttgccagcaacaaatgttcccggctaagggaggctacaaaacctttgtccttttccagtcccatctctcgggccttccgggtgacgctgcgttcggaaacaccgagcatttcagccagctcccggttgagggtattgtgatagtggcgacgcatgatggaaagcatattaccgttccaaaagatacgggtggaatatcccttatgctcgacgagccgtcccagtgtccggtgcatgaaagtaccgtcagcaaccttccggtgcttgcggtactgttcacgcttgtacaccagcacacattcatgacaccaggaactccgtcccccattcttcaacggatagaactcacgcatccacaactttcggccgcaatgcggacagacacgtttacgtttctgcttgttgttattttcactcatagctgtttatgctgcattcatcagttcatattcaaattttcaccgaacggaatagtattaatgtcagcctttctcgtgtaggcctgcataagtcccacggaaagcagcatatagacattcttattcgctttgacaaccccggaaatagagccgacaatatgttcagtcttgccggtaatgattgagccggctatctgctcaagcccgtctggatggtcctcactggccgcaacgctcataaaggcactaagatcgttttccttacaaaagttatccacgtattggcagagttcctttactgcctctttctgtttttctgtaatcatttctgttaaattttaatggttaataattatatgttgaaatcgcgaaatctcttttttgatactggctgtacatagtttcctcccaatccgtctcttcctcctccggaaggtcatcctcatcaagttctacctccttacggtaaatcagataccgtgcctccagaaagaagaggaccacgcggcgcaggaactcacgggcggaggcgatgccgtgcttttccatgaaggaggcgatacggtccggaccgatagtgttcgtgcggatgctcaccagacactgccggcggaagtccttcagcgtgctgcccctcacctcgaacacgcggtcagcgatacggccgagactctccggaatatggtatccggaaccttcgtcatccgttcccaccagcagttcagcagcagccgtcagcataccctccacgctcatgcgctgggcagcggccgtctccttcaggaacacgtactggtaattgctcacgtaggtatgtatgaggtagccttcaggacggcggaacacctcttcggaggcaagctccatcgaaaggttgttcaatgtcacaccggcaccgcagcagaaggcgcacaccaggcggacgacaagacgctggcggttgccccagccgccagcgatgatggcacgctgcaggctgccggcaacggccggatccatctcgaagaacagcaccgacttctcctgacggcggaagaagaacgacatgtccggaatacgatccatgcagaggaggatgcgccgggtggccgtggagaccctgccaccatccgtcatgcggatgtaggacttcaccaggtggttcatcactaccgtcatgtcggaaaaatgatagtcggcaaccttcccgcggaacagttcatgaagcagaacgggcagcttcacaacgtagttgtaatactcctttctcatggctcacttgcttgaaggtttccagtccactgttataatcgcatccagctcaccgctgccgccacacaccgggcaggatacatgcacgtcctcgcggctgccctcttccgttccccagaaccagccgttgcccttgcagtaaccacacttgtggccggtactgacgaagttctcacggttaggccccttacacatataggcgggaggacaaatctccagctgtttctttatcctgctcatgcctggcctcctttctgtttcggtcccgccacattccaatagtcataggcgcccttctcccagattgtgtattcaccagtggccccctgataacgtcccttactgaaggcgacgtagccctctacccatatcttcaggtcggcatcatacatcacgctcgtggccgcatcacctttaggattcttgccacgggcatggctgatgaaaacaaacagcttgtccggaaactcctccttcagctggatatagtcacgatacgtcatctgtgtgtattggaagctgtcaatgatcacgatgttgaaactcttatgacgccggagcctgatcttcaaggtggggatgtcctccttgatgaacgccaaatggcggcttacctcggccataccaaagcgccgcaggttattctggactgtcagagaagttccttcctccagggagttgaacgccacacggtcatacttgcaaagttccttgcagagctgcatcacgaaagaggtcttaccgttaccgctgttgccccacacgaaccagcagccccggacttccggagtgtcgaaggcatccttccatttcccttcgaaagggaatacgtcatacttcttgttcaggatgtccctgacattcaaggcacgtctcatgcccgcttttttattatcctttttctcttcttccatggtcagaacagtgttagttgtcggatattgtcaattcggtcaagtacggcctgccgtgcggcaccccgcagtttctcgtggcagagcatcctgccgagtgcccacaaaagggtattctcacgggtggcaaactgtccccatttacgtcccgggttgaaaccaccgccggaaccgcccacctccatgtgaacgccggcaacccaccagccgtcctgctgtcccacaagggcgtccaggtagtcgcgaccattccggtaaacggtcaccgtctcgtattccctcaagactgggtaatcgctccagggagcgggaagctgctcgcgaccgtcgatctttaagtattcaaatttgttttccatatccttaaaattacgtttgaacggtatttgaacgggggtcattcccccgtcatgcgtttcaccttgtgaatggacttcctcacacgccgcaaatcaaagtcacatgtcgaagcctcctttatcaccttatcgatgtctttcctgtcagtcacaccgttggcggaacagatcgcaaacacgtcgttcacgtccgtaggctccaactcataaaatttccgtccgatacggctgtagaactccttgtagccgggcttctggtaccgcaagccgttgctgatgcgcttggcaatataatcggtactcaagaacacgacaccgcatttctcctccagcttgttgtacaggctgatgaaatagtggaacaccggttcggtcagcttgtccgcctcgtcgaacaccagcaggggcgcgtccatctggatgatgtcatccaatataagcccccacacctcacggatattatacccttcggtccggattccgaccgtacgggcgatctcgcggacaaagtcacctttcttcatgtcctcagagcagaggatatagaaaacctccttatgctcctggaggtaaacacgggcggtggtactcttgccacaaccggcctcgccggtcacccaggtaacattgcgccagcgctgcgcatcggagagtacagccgtgatctcctggtaagcaccggtctccacgatctgccagccggtagcgcttacaccaccgacctgcgaggcgacattacggaacatctcgtcgctgatattctcataacggccattcaggatattgctaacagtacctacactaacccccttcaggctgccagcagccttcgtctggctcgggtatttcgccacgtaagcccggaggctttcactgatggcgtccttttctttcattgtaatttccataatcaatattttttatcttgttataaatctgttccttataatttcccgaccaccttgcggatgctcacttccttcttctcaaagctgtcccatgtcacgttgctgatgactttcatgtctcggccgatggaaggacgggccggctggctgtattttcttgtgcgacggtcaatctggcgttgcgcctcctttccgagacctttcaggtcaggggtacgcagaccgttctgttccggtgcgacaccatgttcgtactcgatgtccttggcaacgacctggcggtttatacgctcgttgatgacggcctcctgctgggcgcggatgaaacgtttctcggcttccgtctgctcctgctgggcacggtggatcatcagcgggaacgaagccacacactcaaagcgcatcgctccgcccttatccttgtacagcagacgtacgctgctcatgtcataaggatcgtactggacatagaacttcttgtaggtgttacgtcggcgccattccagatcaggctcaccgggggcggagaaaacctcgtaagggtatttctttccctgtaccgtgatctcgataccgttggcggtgaacagcgacggtttctcggtcgtgtaccagaacatctccaccatatccgacacacttaccgcatcggtagcctcgttcacgctggtattgtacatctcaatccgggagatgccggtggcagggtgtttcattgaattccactgctcacgggcggcggcatactgttccttcagttcctccaatgtggggagggagtcgatgttcgcgttgatgaattccaaattcggacggcttgtatctctctttgccgtaatattctgcccggtgaaaccgaaacgtttcttcaatacctggctctggaagcggtagaaaatgttctcaatcgtcttagattcgccattatacggagctgtcgggcggtggatacggctgatcttcgagaaaaggcccagcgccgcgttcttcttatgaccgccctggttatcgcacacgatctcgtagggtttgtgccggctcgtctggatagccatgcggaaagcatggtactgggcgatatagtcctcgttgtcgctgatgtaataaccgagcaggacttcactataggcatccaccacctcgtacacgcttgtagtgcacttgtttccgttctcgtcacgatagtagaggttcagcttcgtgccgtcgccataccagaggctgtcacgacggcccggaaggatggtccggtgcttgcggtcataacgctggtgtgccttcatttccccataaacggcatcgtaccacagaggttcgacacgcgggctgttgaaccattcgcggaggctgcggggactcttcaggggcttccagccacgttccggagcgacacggttgtactcctcgaagatctccatgtcagtataaaccggaacgcggctgcgtttcaatgctacaaggtaacgcccgccgtcctcctcgatcttcagcgtgttgctgttgccgtatttaccgctcacaagcacaccgtagttgtcgggacggaacttgtttatcagggctttcaaacgccccacactgcccggaagactgtgcccgtacaccggacgccattcctcactcgtgacaagcagaagttcccaaaggttacggcggaaaccggtcagcttgttattggatgaactcaagcgtttgaactcttccatcaacgcgttcagcaccgaagcgttccaggtgtattccttcttcacatcctcgggaagagcgaccatctcaccgttcttgtcgtaacggtaatcctcgaaaaagttctcggccttctcgtctttcttcactatgttacggatcatttcctgtctcatttgtttctcgggttcgccatgacgctcaacccaacgtttcttgtatttctcgggaagggaggaataggcatacagagccggattattttcaccaccgccacgggaaacgacatccagtttttctcgggacagctggctattcaaagtgcctttgggcattatatccagcaactctttgtaagttacacacaatatattatcaaagtattccatctcccagcttgattatcaatcctctaaatcattcaaagggacatgcttcttcagcagccgcacggagatcccgaaattcaacactacgagaagttccagcagcggattaataaaaaaaatagagagcaggatcccgaaactcatacagaagtaaagcacgcaaaagcgctgttttcgtttcagacgagcaaaccagtgcagctggtcgctgaacaatgtcatcaaatcatttttcatggctacttgtattttgaggattaccacctactttggatccaccgcgctcaatggcgagcttacgaatggaacgggccagtttgctgttcttacggaaggcaagcgcatgactcaccatcacgtttgtacagcccatcagttcggcaattttattcacctcaccgtattctacaactattcgttctttcatactatctaatatttaaattatcgtagtgggcagtcgcggattcgaaccgcggaccataacctctccattataggagtttagtttgttctaccagctgaactaactgcccgagaaaattattaaagctcctttatcgcatcctccggaacacatattacagtccaaacctgaccatttttcatataatcgatattatattcccgcacgaacgtacaaatgttataatcccagtcacgaactataccatcaatgatctcaccatttctcttggtgattctcacactttgtccctttttaaattttacttccattttgcttctttttaaattctcattgttacctcaagccttttttgtagctttggggcgtgtttaaactttaatcacgtggcaaatatagtctaagtttcttagacaacaaagtattaatccaaataatttagatttatgagcgttttttctaagaatcttagatatctaagggagagtaggggacttaaattagatgaatttgagtttctgggcatcaaaaaaggtacaatgtcaaactatgaactgggtaatacagaacctaaattgagtttgttatgtgaaatatctaagttttttagaatatcaatcgacgactttcttttaaaagatatagaagccgaaaaaattacaccagtagtaacggaaacagctcctccagaaacagctaacaataattttagggagcttctggatgttttaagggaaaaagactccaccattcgagaaatggcagaggaaatagggatgctcaaacagacaattacacaacttaaacaggacaagtcggggcgtgtttcggatgcaagcgattctacggttgccaatgccatctaaaacgtgttttatggggaaagggaggtaaaaacagttaaatcactattttacagcagaatatataaaaatacaggggagtaaataaatattatctatatacaatttaccccctacaatattataaaaaccgatgaataccaaataaaaaaaagatatttccccgttttattagaacaaaataggcacaaaaatgaataaccaaatgaataagcaatcaaaacatttcgtttttgtaatagcttaaatgaataaccaaatgaataagcaagtgaataacctttccactttttaagacgttcaaagcgttcaaacggataaatacagccttccatcatagtttgacacttataagggcaaaaaaagccgcttttgcggcttttaattgcgttctaaggcattttatccctttctggtacatgttatcaagcgagactgaataatcattgcacgtttcgtgtatttggcaatgtcatcaaccagtccagcatgtaaaagactactcttagtgattccgacctgtttctccgtcagagtttcaaaaatggccgatatactaccaaagtagatgttctttttctcaaaaatcaaatgtacatggataactttactcatgatatatagtatttatttcactgcaaatataccaaatatcagctatatggaataattttaataaataaaaataggagagaagcgaagcgctcccctactccacttgcataaattacaccatttggttatctttgtatatggaagtatggcctgggcaaagcatcggagtgaaataataccatactgcctgaattctcccctactccactcctaatgtaaagagattcatttgaacggcgttcaaacaaggttcaaatgtaagctcgatgtaaagcgatgtaaacgcttcgtttttccacccagctcactcctaccccgttctaacgctttgaaaaccaaagcaatcagatattttcagaccgaccgaactttgacacgcatcgtttctccccccttacttacctttaccttgaaaatctcctcaaaggctttcaacgttgccctgttgtcgggccggaacggatagattatctgattcaggaaatatcagagataaaaaacattctgataaacagaatagaaaaaagggaagaaataccaaagtggctgaataaggagcaagccttaaaatatattcaaaaacaaggatataaattaagttcatcgaaactctataaattatcagcaacagataatataccttgtcacaggtcaggacgtaatctgtatttctttgctgaagaattggataaatggttaaacaaccaaattgaggaggaaggcaaaacgagccaaaatctttcaactcaatcaatacaattaattataaaatcggctcaacaaagataggagataaataatatgaatagtaatagcaacaataataatattccaatgataaatcatccgtataaaacagcaaaaggcttgaaacgatatgtaagagatattttgcagcaagtacaacaagaggaaacattgaagaaaataatagatatatcttcaaaaatagactatccggttatttatcatcttgatgatgataaaaaacttgaaaaacttgcagaactacgtaggaaagaaaacaatgggggattgtcagaaaatgaaacaagagaattaaaggggttagagccggatgatgaagtcaaatatattatattgatagaagaattaatgaagaacgcggatgagtttaaattggggctcggcattgagccggacagtattcagccatatatttatacgggctgttactggaaaaacataacccgtccacttttgaaggaatttcttgccgtagcggcaaataaggcagacttcaattattatgatattagactgagtaggaatcttgagagattgtataatcagtttgtcgctctttgcactcttgtaccggacttgaatgagaaaaaagatgaggtgaaaattaatctaaagaatgggacatttgtcatttcaaaggacaaacaagagttgagagactttgacaagcgggacttttttaaatatcaattgccttttgaatacaattctaaagcgacttgtgatgattttaaggctttcttgaatgaggttttacctgaaaaagaatcacaaatgattcttgcagaatatttgggatatatttttactcaaaacttgaaattagaaaagtgtttgattttgaaaggtgaaggaagcaacggtaaatccgtcatatttgaaatagtgcaagcactgcttggagaacacaacacttgttcctatacgataagtaatttatgtaatgaaaatggatattttagggcacaattaggtaattatctgcttaactattcgtcagaactcggaggaaagaatatcaatcctgacttgttcaagaagctaatcagcaatgagcctattgatgcgcgttctccttatggacatccgtttattattcggaattatggaaagtttatgtttaacactaacaaatttcctaataatattgaatttacccatgcctacttgcgaagatttataatcttgaactttgaagtgattattccggatgaaaaacaagataaacatctcgccaagaaaataatatccaaagaattaagcggtattttcaattgggtgctggagggattgggaaggttgttgaagcaacaacaatttacagaatcgccaaaggcaaaagaacttcttgaggaaatgagatttgaatctgatagtgtggcacaattcatagaggcaaaaaaatacgtgccttctgtatcagataatgatagagttttattaaaagattttagagaagaatataatgcgtattgttgtataaagaagttgatacctgtgagacgaaaagaattttcaactcgcataaagagtttgaaatttgagattgagaaaggtggtggtgggaataattatatttttgtgaaaagtaataatattgctaaacaatttgtagaaaattcattgcctgatggcctgtaaaaaagtaagaaatatggaaaatatcataaaagtatcaatgtttgaaagtgcgcaaaatcgttatgcaagcggagtagtgaacttatgggactggttgttcttagaggactatcgtactgttttaatcaaagaacttcgaaatgaatctgatttgatgaaacggcgagaattgaaagaacttcttcctgcaataactgtcagttgtgtttgttctgaacgacgaactgaaaaaatttacgagtatacgaacttgatttgtattgatattgacggaaaagataacccgtcaatatcaaacatagaagaccttaagattaagttgggtgaactaccttatattatgtattgtggattgtctgcaagcggaaatggcttgttctgtatcattccttatgcggaccctactaatcataagaatgtctttgaagccataaaaaacgattttgaagaaatgggtatcattatagataaaagttgtggcgatatatgccgtttacgcttcctttcgcatgatacgcaaccgtatgtcaataaacatgcggaagtttatacgtctaagccaaaaactataagccaaaacagaaatataaaacgaaaccacctaaaccccgaacgcttcttatccccaatgcgatagaaacctttcttcgtccaaataattttgttttggaaagtgccactcctttaacaaagaaacaaaaggttgagcggctattgaatgaaataaccagaaatcaagtggatattacttattattatgatgattggattgccattggcaatatcattaagaatatgtttggtgaggaaggtagggctttatttcataaggtcagtagtttttatcccaattatgattatgatgaaactgatagggaatattccggtatgataattggacggtatcgatataatagtgaccgcttatttgaaatagccgcagaatacaagctcatttccccaatcaaaaaataattttgagaagaaaagggatgactaccggtgtgtagcttatctcttttcttatatccgtttgtgcaaattatatgcgaaaacctcatcatgggcataaatcggagagcactcttgccaatagaagaaactaaaagaaaaagaatatcatttaccggtgtgtcacgtttatcattgattatcaccactttccaaaggttgtgtgcaaattgtgtgcaaggagttttagtgtgcaagaaaaaagccgctacaaggttgcttgtaacggcttgattttctttgttttatgcttcgtggaccagcctgggcttgaaccagggacctccagattatgagtctttttgtggattatttcatgggattgtataaagtgtaattgtattgataatcagcatctaacacattttgctgtttgcagaaaaatacgtatatttgcagtggttttcgtgcgaaaaggtcacctgaaggtcaccaaaacgagcagaatattaactataaataagtgcattatggagattgaaaaaacgaataaggtcaccgaaatggcaaagaagaacggaaaatccaatgcaagaggagaaaaatgccttgcgaaatttacggctgcgaatggtaatgtatatggttcgctgactcttgacatacgaaaagcgggcgactattcgcaaccgcttccagtagctgtgcgtgtgtgtcatggcggacaaaagattttcctgcgtttaggaaaatcatacactatggaagaatggttggttctttgcgattatgagaaaagcggtcggcgcatccaattagcggagcgtaacgatatgaagaatctgatggacagagtggaactgatggttaaccaacttatctcggaaaacaatttctctcttcgcaagttgcaagacaggttccaaggcaagaaagacgatgacagcaccatcatcacagtttgggattcgtacattcaatctaagaccaatgaaggcaaggctggttccgctcgttgtagtaaggatgtacgcaaccgctttgtgaaagatttgggaacggatgtatcgtttgcagatattaaccgtgactttatcttgaaatgggtaaaaatcatgaagaagaatgaattgagcaccaccactattgctatcgcacttcgcagtctaaggactataatcaatatgtgcatcgctaacggactgatgaaaggtgataccaaagaaatgtttaaggacacgggctacaacaaagcgcagagccgtaaacatgagtttcttgacgtggctaccatgcgaaagctctatgacttttggaaagctgacgaagcaaaagacaaagatggaaatgagctgttcctcggcagagagaagtatgccatatttcgcgaccttggactattcctttttatgtatttgggcgatggacagaaccttgctgatacactccgactgacttatgatgaactatactatgccactcatggcaagcagcttcgtttccttcgccacaaaactcgtgagcggaacgagagtgccagtgaagtgatatttcctgtcactcccgagattcaagagatactcaaccggtatggcaatgtcccaaaacttgggcggagggtattccccatcatgagtgagctaatcacaccagaacaagagatatgggttatccaacgctacaacagatatatacgtgagcacatggcaaaagttgccaaactattgaatatggaacaggcaccatcacccacttgggcaaggcacagcttcgcaaccaacctcaataactctggtgtcgtaccttataaatatataagcgacagcatggggcatagtggcggcggtgacattacttccaattatatcggtgcctatcctcttgcaaagatgctggagtataaccattatctactcaatgagaagtcgaaagaaagtactcctgtggtagataagaaagccctgcttgagatgctgaaaggcttgagcgaggaggaacggatggagttgatggctaacttatcagactaattatagtcactcaccgcaagaatgccaagtgaaataccgcaaaaaagaggattggaatgccacaaaaatgccgaataaaacaccgcaaaaaagtggattgaaatgccacaaaaaacacgaattggccatgcatttcgcagaaaatgtgtatctttgcaattgaaaaagcatattatatgagttactataaaagaactgccgatgccctattgcaagacttgctggatgcatttggggctgtattgatagaaggaccaaaatggtgtggcaaaaccacgactgcgtctcaacttgcaaacagcatcttgagaatgcaagatcctagtttgcgtgaggagtatttggtcaccgctaaaactaagccgtccattctgttaaatggagctacgcctcgccttattgatgagtggcaagatgctccaatgttgtgggatgcagtacgaactgttgttgatgatcgtcaaatccccggacaatttatacttacaggttccaatgccgttgacaaatcccaaatacaccattctggagttggtcgtattgccagactgcgtatgctgcctatgagtttgtgggaatcacaagaatctacaggtgaagtttcgttgaaagaacttttcaacaatccagattatgatattgacggtaagatgtctaagatgaccgttgaggaattaatctttgcagcctcccgaggcggatggccagcttctttgttggctcgtacccaaaaggctcaactactcgttgcaaagaactatgttcaaacaatttgctccaacgacatttccagtattgatggcaagaaaagagatgccagactgaccagtatgatacttcgggcgtatgccagaaatgtttcgactctggtcaagaagaagtcgcttttggatgatgtgacctcatctggcgaagtaagttgccacgtggacacatttgatgactatgttgcagctttggaaaagctatttgttatccagaacataagtgcatggtgtcctgcaattagaagtaaaaccgctatcagaagtggcgtgaaacgatgtttctgtgacccatctataccgattgcccttctgggactatctcccgaatcattaagcatgcaacttaagacttttggatttatctttgagcagatgtgtattcgtgacctaaaggcgtacactattgatttaaacagccatgtatcttactaccatgaccgatacgacttggaagctgatatagtgctgcatttggaagatgggcgatatgccttgattgagtgcaaactcggtagtcgtgagatagatgatggtgccaagcatttacttgaacttaaaaggcttatacaggaacataacaagacggagaagcaagtgcctattcgggaacctgatttacttattgtgatgacgggtggtacaatggcatacactcgtcctgatggagtgaaggtcattcctttggcttgtctcaaagattaaccaattaaagaaaacaatctatatgggcgataattcgaaggagcttcccaacgccaaacttcatcttcaagagaagatgagggaatggcttggagcgaaccaagaaatctattccaagttcaaggacaaaattcaatctgtcttgaaggactcattgcgcgataatgtcgaagaacaggcagatgaagaaatggctgcataccaaaacgcaatcttggaagtagaagtattggataaggaagatggtctggacaatttgatagacagattcatgactgccataaaagacaggaatgtgttcgcttgctgtttgtactgctacttggaactggataacggatttgaagagttggcagatgtcatggcggaatctgaactgccagaggatgcaacgtacataaaagatggtatcaaagcctatttgcaggacaaaagccgcgaaactcaagggactgtcaataaggatttaaacttactcagtttgcgtcgctggcactatgaccaccccgaagactatgaagattttaccaatctttttgccaaagcatacgagggcgacgtgactttcttcataaaaggcatatcatacttggcagagatgctatcgctcaatgggattactagtattactgacttgcttgaaagcctttgtccaggaacagaaagctacaataaagcccaattcgcaagcagccagcaacaagttcatgagaaactgaccactttgttcgtctctacattcaatcaagaggctacgaaacaaaaaatcctgcataacaatccttttatgtgcagcgcattctattggatgatatttgataatggtttcgtgaaggccgctgatttattatccaaaacaatgatgagagagaagccttctttctggcagaagaactttggcgaacaaattatgcgctctttgatgcttaccagtatggataaagcgacttacactaaaggcacatggaaagcagcaaacaatcgtgtagtcaaagatgtagctatttctgcattacaagagagtaaaggcagacgtggacgtaagcaagtctgtgtcctgcttgaagaaatgcttatacaaccttatgcagaacttcttaccaacgaaatagaaaaaatactcactgaatggatggaaacgaaaggtacagactcagttcttgcgtatgtatttgctgcattgaccagttgcaacttgcttaatgactcctacaactatcggactttccatacagctatcttggaaaagtttccgtcccttggctttaagcctggttttgattgggcagaagccctttataatgccattgtcagtgaacatgactacgactataatttgaacctatcagaaaaagcaatccagaccggaaaggaactggcaaagttgataaacataagactgcgcaccttactttcccctaatgtatattgattgcatcatgaaggcttgatttgttaaaaagaaacgctgttccgttaaaagcacctcggcagaaatcgtcatgatttttaccgaggtgctttcattttattccatcgtaatttcgcagcgtaattattaaaacaacatgatatgcaaggcaattttataatgttacagaaggatgacctgaaacaggttgtttctgaattggtggaagaattagtttggaaaaagccacaggccgatttgacaccagaagagagtgacgagtattttactcgcgatcaggtatgtgaacgactccacataacctataccaccttgtggcgtatgcagaaggaaggaagaattatagttcacaaattgggtggacgtaatctttactcgaagaaggaaatcttctcacttctgaaagctaaagtacagactgctaatagcgctaatccaaatgtttaatctaaaagcaagcattatggaagaacaatacattcgagttggcactactatatataaggtagtgcagcagcctttggcagatggaacgatgactacccgcagattgcaatggagctttggcactatccgacaagattatggtaagcacaatatccctactatggataaatataatggtttttgcacagtgccaagtcacacagactaccaaaaggatgttgcaggtttctataatctgtatgaaccaattgaccatgttccggcagaagggaatttctctgatattgaaaaactgctacaccacatctttgaggagcaatacgaactggggttggactatatgcagttgctttatatgcagccgactcagaaactccccatcctgttattggtgtcagaggaacgaaacacaggaaagaccactttcctgaactttctgaaaagtatctttcaggacaatgccacctttaatacaaacgaggatttcaggagccagttcaatgcagactgggctggcaagctactcatcgttgtggacgaggtgctgttgagtcgtagagaagattcagagcgattgaagaacctaagcacagcccaaacctacaaggtagaggccaagggtaaagacagacaggaggtaaacttctttgccaagttcgtactatgttccaacaacgaactttaccctgttatcattgacccgggagaaaaccgctattgggtgcgtaaaatccgaccacttgaaagcgatgataccaatttcctgcaaaagctaaaggaacagatacctgcattcctctattatctccagcaccgcacactctccactaacaaagaggggcgtatgtggtttcatcctacccttatcaagacagaggctcttgaccgcattatccagtgcaaccgcaaccatacggagttggatatggtagagctgatacgtgatattatggaaacgcaacacgttgacaagctgtcgttcatccctcaagacttgataccgttactgactatgaacggtgtaaaagtggagcaatggcagatacgaaaggtcgtgaaagatgtctggcgacttacccctgctcacaatgcactgacctatcttgcctatcaatgtgactacactaagccggggcgtgtttcctcaattagcagagtgggacgtttctacacggtgaccaaggaatttatagactctttaggtttataattctttgttgagttgttgaattgttgagaacaacagactaatctttggtactcaaataaatacaattcaacaagcactcaacaagaggtgtaactgggcaaaagagaaacctatttttcttttcaccagcccattatctcaacaactcaacatttcaacaaatcactcacattatgactatacaagaaataaaggcaatccaaatatccaacttcctcgcaagcaagggatatgaaccaataaacagaaaaggaaataagtggtggtacttatcgccactacatacggagaaaaccgcatcatttaaggtggatttaaccaaaaacgtgtggtatgactttgcactgggcaaaggaggtaacatcattgatttggcgatgcaactataccacacgcaaaacatttcagaagtattgcacatgatggggcatttaatcattctacccacaataccaatccattctacttgctcacaaaaggacacttcgtttgaagatattaaggtaaaagaactggctcatcctgcattgctacaatacctctcgggaaggggtgttgattctattacagccaaaaggcagtgcgtggaaatacactacaaaagtgctggcaagcgatattttgctattggcttcaagaatgatgctggtggctatgaacttcggaatccatacttcaagggatgtattgctccgaaagcaatcactacgataaggaaccacgaaacagcttgtcacatattcgagggattcgtggactatctctcctatctcatactacatggcgaatgtgatgcggtggtactcaactccattgtaaacatcccgagtgctctctccatgctcaataagtattctcaaatatgctgccacttggataatgacaaagctggcagaatggccacctggcagataatgaaagcattgggagacaagtgtactgatgcctcaaatgagtatgaagaatacaaagatctcaacgagtatctgatgaacaaaagcatggcattccaacaaaagggaagaaacaaattctgacttggcggctggacgcaaagaggtgtggcgtgcacgacagggcttgccctgatatagcctactataacttctccactttgctcccgaagttgtgggctctcccgaggggctgggcgttgccccgtcccacttaggacgctgccctaagaacccggcaaggactgtcagtcctatgcaacccgaccaaagagtgaccctctctttggaaactccgttcagaggcttcacccctgaaaaccccgagcaggaagtgaccctctccctgcaccctccgattaaggctttgccctaataaccctttttaatataaatctctaaaagcataagtaaaatggcacagaaaacatccattaatatcaaaccctgtaacattggtagtagtgaggcacataacaaaagaacagcagaatacctcgctcatatcaacaaagagaggctttatgtccgtactgaccttatggcttcaaacgaagtatgggtagcaccagaattgggcaacagctcattaactgaccgctacaatcagattgcccaaatggtcaaggaaaagactggtcggaaaatgcaaaccaaagaccgtgaacgaatgaacaagaagacaggcaaggtgactatcgtgcgtggcagcaccccactcaaagagggtgtcgtggtaatcaaagatgataccacgttggagcagttgcagcatttttgtgaggagtgtaaggagcattggggtatcacagctttgcaaatcttcatccaccgtgacgaggggcattacggcaatctcggagataccgccacatggatgcccaatcttcacgcccatatcgtatgggattggatgaaccacgatactggaaaatcctgcaaactggacgagaaatgcatgggcgagatgcagacgcttttggctgagtgcttagagatggaaaggggtatatcaaaagatcttacaggtaagaagcatttggaaaggacggacttcatcatagccaagcagaagcaggaagcggagcaagctaaagcagaaaaggaaaaagctgtcaccgccaaagcgaaagccgaagccgagcgcaactccatagaggttgagaataaggctaaatctgaacggagtgcggcacttgacagcgagatagccgacaagcagaaaaagcgtgatgcaatccgcagaaacatggtggacggtatcttggatagtgtcggcagtctggtcggtattggtaagactgccactcttgaaatggagtacaagctgctcgcacaggaatatgatcgccttaaaaaggcgtttaggccgactgtcatcaaagaggtggagaagcagacaaaggaactggctttggaaaagcagaaagccgaagcgcaacgtgataatgtcattgcgcaaagttgttctattgcttcagaacgtgacaaggctattaaagaacttaacagtctaaacgaaaatgtgcaactgcgcatcaataatgcggtcaaacttgccaatgcggagaaagacaagaccatcagccgattgcaaggtgagttgaattcacgcaagctggtttttgctattattgccgatatgctctatgctgccagtgaggtattcaaacgtgccattgatgcaattattcactacagcacggacaaatacaagtctatctttggcagtgatgaagctgctgacatcaagagcgtgatgcagagctatggcaagaccaaagagcagcagcaaacaatcggaagatggctttgcgactatgcggacagccgacagtcttttgataaaataaaacatcggcagacctacaaggaggttgctgatgtcgctaatggggcttatgattggaaaatagaacaaaatcaggtaggaatacgtagataagaactatatgacatggcaattaaatcagagaaactcactccttttggaggaatactttcaatcatggagaaattcggtagtgtaaacagagccgtgatacagttcagtttacactaccgttatgcgtgaatttgacttatcttccgctcttttgctgaaacagcgtctattgcaagagggaaaaagcgatctcttgttttctagattgtcagttaaagagacggcttatcgtttgcatttctttgagcctaaccacctgatgcgttttttcaaacaaatgacaagacaggctatcagtaaatttatcaaatcaatcaaatgatcctatttttttagcctaattttttcatgatagaaatagtttactataacaggttttcctttttgagaacgcccgtatagtaaatcgtttatacgataaggataaccttccgcttgagcaaacgcagctacttcctgttccaagacctgccagtaatcttttcgtttcttgttgtaggtatcatcatacaaggctacaagctccggatgcttttcccgtatataccccatgatgtctctcttaaattgtccacgaagattcagattttccagccatatcaaatctgcataatcttttacccgattaacgatagctttcacatctgtaattcctggaaaaatcggtgaaataaaacacacggtgcgtatgcctgcattatagatctgtttcatggctttaagtcttcgctcaatgcttacggcacgatccatatcacatctgaactgttcatcgagtgtgttaactgaccaagatactgtcactttctgaaagcctttaagtaaatcaagatcacgcaaaaccaaatctgacttagtacaaatcatgatttcagcattagtgccttttaactcttccagcagtttacgggttctgcaaaaatcttcttcatacggatggtatccgtctgttacagaaccgataacaatccgttgtccatcatatttatgcggattatcaataggtttccaatgctttacatccagaaacgtaccccaaggctctgtatgccctgtaaaacgtttcatgaatgaagcatagcagtacttacaagcatgaggacaacctacataaggattgacagagaagccccctactggtaatgaggatttagtcatgacattctgtacatctatttctctgattatttccttttccatattttttctataaattgtttcggtagttcttgaatcattcggtattctcccattataggcaaaaggtattctttcataaataccaaaatataatttcttttcgcctgttctacaatatgacgtactcattcaggattggcatctactttccctttccttttgcctgtttccgttcctataacaatccattcgtaaccctcttttcaggctgtttcccaatcagagaagtcgctcataatattattgtttctccatcttctggaataatcaggcgactcatttctattttgtgatgcatggcttcgttacgcagaattgcgcgtgtagtctgcccatgatcggtagcttccatgtggactgctattagtttgatgtgggcgggaagttcatcgagcattgtcataacttcttgctcatctggaatgatagaaccttctgtttgagaaaattcaggaaaaattgcacctccactgttcactatgatgtaatctggagaaaattgttcaatggcctgacggatacagtcttcccatttacagtcactcattatataaatagtagggaaaccgtgtgcagtaagtacatagcctgataccggccccatcatttctccaatctttccgaagccatggtgtccttggatgcgatgaatggttaaatttccaatagctttatctttttcaatgctttctacatttgtaaaaccatcctgtgtaatactctctttatcttgcggttgtgtcaggaacaggatgttcttcgctaaatgctgtttcactgtcgggtcgtaatggtcaatatggttgtgtgtcaacaataccatatccagaccgtccgcaatttcattcatcggcatcgtgaggtgtactcttggggtcttatacacacctagagccgactgtaaagtgcctttttcggcaagcatggggtcaacaagtatctcttttccagcataatggattcgcaatgttgcattacggatcaatcgaattgttactttttcttccatcataatttattgtattgattatagccgcaaagttcggtaaaaaaaatcggatgcattatgccttaaaaacaggaatatatgccattttgataaataaaaaatagtatatttgcccccaaaaacgaaatctatggataaaatcgtcaatcctgaacgtctggtcagcgttccatttagcaagacacgctgtggtgtggacttttatatcaactcaggctacagtagcgatgtatgtggtgtcctgacggaaaaccgggtgtttaaaacagatttctttagcttctatttttttcgtaaggccaatgggtatctgctgctgaatttccgcaaatttgaattgcatgccaatatggtactcctcctctcgccgcatcagcagcaggaatggcacgtggatgaagcagaactagattactcttttcttatattccgcgaggattttatgcgcacattcttagcggacaagttttttgtgtaccgcttgctgtattattatcagaccgacacgcctccctatctgtttgcttcgccggaaagcatggcggagtatattcgtcttttaggaatcataaagcaggagcttctgcatcctgttgccgatacttataatctcattgtatctgtgctttactacttattggttattatcaaccgggcgtatgccgccacttatcatttaccgattgatgtacctaaaaacaattacgcattccagtttaaggacttgctggaaaagaatatccgtacgaaacagcgggtgcaggaatatgcggatatgctccgtgtgagccgtattacgttaaacagttccgtgatgagtcaattcggcgtatctgccaatcatctgctcaagcagcgtctgttggaagaattgaagaatgagttactgtttgctaaccgaaacgtgaaccagctggccgaagagtttcatttctccgacccgagtcatctgatgcgtttctttaaacgtgaaactggaaagacttttacgcaatatttgcgcgactaccaaaatggaatatacgaatgaaaacggacagactggaaagcttgcagattgaccattcccataccaaagatgttttcaacgacttacaaatatgcttagtgggaaatcctatttcggcctaaaatgtgcatcacattccgcagtgtcaagttcaccatagaataaaaatctataaaaattctctgcaatcccatgaaatttcaaaaggtcactcttgcagagtttcgcctaaaaaaggtcacctgaaggtcacccgtaaaagaaaaagcacctacagaaactctgtaagtgcttgattattagcgtggaccagcctgggcttgaaccagggacctccagattatgagactttatatttagactttataaaaggctatttatcaacaagtttataatctctttgtaagcttgttagtcaacaattagtcaacattaaatttacgatacaaatatacaaattcttgtttattttaagatgtttcattccatttgatttaaggatttgttcaacatttctgtaatagggggcttataattgaaatatcctctctaaaaggttgtattagtccatacatggagttaaatgggtctctccattaacctctttatcttttataatggctaagtagtgtatagttgaaatacagccatctctccattccagtatttaataatgagatattaacattagtttcccctctgtaatatggttaacttcgtatcagattaattcaattatcaattatcaaattaatacaattatgagacttaccaagaagaactctcctaaaagttacactatctactacctaccacaagagattaaagaaactatggttacagaggtcagttacctgcctattaccagagagagactggaacagttctttaaagatgcggcaagtaaacgaaagcctaaattagtcaagaagcggaaacagtcaaggcagcaagggagttaattccatgctgcctttatacttcaatacttatttccttttatatgaattagtcaagacttaatctgacagttacgtataaaaagaataaatttgtaactccctgattattaatgaaattaacaagatttcattacctgcgaagtaacggaaaatcatataacaaaacggatataggaatggaatataaaatgagagattattcacttttttattttttaaatttataaatttaaagttttcaattatgaacaagaagtttctaagtgtgatcctgttcagtgccttaatggttggtactgcaggaacgtttacgtcttgtaaggactacgatgatgacatcaacaacttgcaggaacaaatcgacggtcaaaatggtctgagtgccaagattactgctgtagagagctcaatcagcaatttgcagtctgcacaaagtggtttgcagagtgaaatcgctgctgcaaaagacgaggcttcaaaggctgcccttgcagcacaagaagctgctattgctgcagcaaaggctgaattggaaaaagtcaaagccgagttgcaagaggccgacaaagccggtatagcagcaatagaagaaaaactggctgaaatttcaggtagaatccagactttggaacagttcaaaactactactgaagcaacattggaaaaattggcagcagcagatgtagctttgcagagcagcatcactaccttgaaagctgatgtcgctgccaatgcagaacagattggtaagaacaaagctgccattgaagcacaaattgccgctttggatgaatataaaggaaccaacgatgctgccattgctgctttaaaagctgatttggaaaaattgcaagctggcgagctgacagaagaaatggctgcaaaaattgcagcacaagtaacagaagttgtaggcgctaaattagacttgatttctgctgcattcagtaaagctgttactcatgtagaattgttgaattattcattcggcagcaaaactgacaatattattgaaggtgagccttctataatggatttgcgtactgctgaagctgtagaagaccgtgtgtttggtaaaggcagctccgacgaagtagaggcaaattcttatgaaatcattaatcaaaaggagttcaaaaaaggtgaaagagcattcatcagcgactctgtattgattcgtgtgtcaccggctaatgccaccttgaccgaaggacagatttcatttgtcaattctgcactgggcaatctagatgaactggtgactgttgagaaagtggagcagtttaaaggcacagtaaccaccagaggtgtatcttctaatggtctgtggaaagtcgtattcaagttgaacaaggataactatacagaagagaatttgctgaaagctgcaaagtttgactataagagcggcaacgctgaagacgaaccggtgaagaaactgaaggatattctctacgcagtagcagtaacagacaaaccgggcgacgtggaacgtagtgtgacaaccggttatgaattgacactgggttctgtatatacaccgcagtatgaactgaatttcaaggtcaacgacaaggatgtgaatgatctgcgtaaccgtttccagtatgctgaagatggaactttaactgctgatgcaagcaaaaagctgttctatgactataaatggaatgttgatagaaacggaaaccgtatagaggaaaacggctcttatgtatctattgatgctactactaaatatggcacatggagagaccaagacctttggaggggtggcgataaccgtgacaaagaaggttctagcaaatctttcttctctacaaaagtgggtgaaaagtttaccgtagaattgagttatagtgatgaggatatcagtggtatctatggtttctatgtagtgctcgacgcgcaacgtgccgtagaaagtgctccgtctgaaatcacggcatggaactcttatgaggcagatatcgaaggactgaatacaattacgacaaaccgtaagattgaaatgtctatcaatgcagagaaggctgatggtgacattatcggtttccgcgtatatgcagtaaataataacggttctttggttgacccggacggtaaggcattctatgtagcagtaggcgacatcgatgctatgactactacgttgaaggctgattacgtaccggtatggaatgctcctgatggtgattacgaacgtgatgttgagattgatttggacgaagaacttctgaaactgtttgaagataaatataatgaatatgaggaaggtaatttgatatttgacatagagaataatccgaatgacaatgaaaatttcgtcaaaaacttcgacagacaggaaggcaagttagttatttcattgaagggtaatttgaataagttcaaggataatggtacttataagatgtatttcaactttaccgatagtaagaagaatgtaatagttaagaaagttgccattgaaataaccaagaagatgccagaattccctgctgcattctctgctaaggccaaccaacttgacaaagaaggcgcaaaggttgttgaagtaacagaagctaactggaatactactatccataatctgggtacagcattcaatggcgtttctgatcctaccaacgcaatcatcgacttcaactatacattcacttgcgcagaaaagcagattgtattctactctgataaggcaagtgctgctagatatggattctatctcgatgtaaacaatgacaaggataaagcagcagctctgtttgcagataaaccagaaggaaagatgtacgatgtaaccgtatcctataagtacagcaatgtttcatcagaaacggcagactactcttacactgtaaaagccccggctgcccagaacttcaaactgagacttgtatgtggtgaaggtttcacttctgaatggaagaactttgatgacaagaagaatccaattaaggaatccttaatctataacgtttctgaaacaagaattgctcttgctaatattctgaagttcaagaaaggtgatatagattacacgcctacttttgttgctgcaaatatcaaagaatgccacttggcttctaacaatgtggatgacgaatactttactgtaacatttgatgcggttactcaagaatttgtatttgtttcaagattgggacaaaatccaccgacttctgatgttattgcaaccttgaagttcacaatggtagacttcttcggacacgaaaatcctgaggaatatccatacttcgttattaagaaataattttttcattcttagtaattgatgaaagagaagcctaactgaaaaaataagcttccgtactttatgagggtaggagaaaacaaaattgttttctcctacttttttctccctactttgcttccacacttccacccacctcctgcatccccctgtccatcggcatttaccccgctgtggaagtaactcccaaaagtggaagcaaaatttgcttccacctattcaagacgccatagttttaccataactagctcattcttattttaatacatcgaacaaagtttataaaacacttgcaccagtttccccatacttctccccccatcctacccataaaatctgcaatacccatatccccccttatcttcatcccaaatccacaacagcctcctccccctcctcagcataaaaaatgcccccgttcatttcattctccctccactttccactatctttgtccccgcgatgaaaaagtttgccgacgtcatattgcctttgcctttgcacagctgcttcacctactccctgcccgacgagtgggcggatgaagtgcagaccggttgccgggtggtagtgccattcggacggaagaaatactatacagccatcgtgcgcaacgtgcactattgtgcccccaccgaatacgaagtaaaggaagtgtccgccttgctggatgcccgccccatactgctcccgcggcagttcaagttctgggaatggctctccgactactacctctgcacacaaggagacgtctacaaagccgccctaccctccggtctgaagctggaaagcgaaacaatcgtagagtacaaccccgatttcgagtccgacgtccgcctgccggagaaggaacagaagatactggatatgctctctgccgacccggagcaatgcgtgacgaaactggagaaagagaccggcatcaagaacatactttctgtcatcaagtcactgctcgacaaagaggccatcttcgtaaaggaagaattgcgccgtacctataagcctaagaccgaaaaccgagtgcgccttaccactgccgcccgcaacgaacaccgcctgcacatcttcttcgacgagttgcagcgccgtgcccccaagcaactggacctgctgatgaagtacctggaactctccggctacctcagcggacgagatataaaagaagtctccaaagccgaactgctgcaacgcacctccgccacccctgccgtattcaacggtcttgtggaccgtggtgtattcgaagtctaccagcaggaaataggccgcatagacaaaacactcctcaaagaagtcatccccgtcaacccgctgaacgagcaccagcaacgcgcttatcactccatcttagagaattttcaaagcaagaacgtctgcctgctgcatggcgtcacggcaagcggcaagaccgaagtctatattcatctgatagaagaaaccatccggcaaggaaagcaagtgctctatctcctgcccgaaatagctctcactgcacaaatcacagagcgcctgcaacgcgtattcggctcccgactgggcatctatcactccaagttccccgatgccgaacgggtggaaatctggcagaagcagctgtcggaagcagactatgacattattctcggcgtccgctcctccgtcttccttcctttccgcaacctcggtctcgtgattgtggacgaggagcacgaaaacacctacaagcagcaagaccccgcccctcgctatcatgctcgcaatgcagccattgtactcgcctccatgtacggcgccaaaactctgttgggtacggcaaccccttctgtagagacttggcacaatgccacatccggtaagtatggcctcgtggaactgaaagaacgctataaagagatacaactgccggagattatccccgtagacattaaggagctgcaccgcaagaagatgatgaaaggtccgttctctccattgctcctgcaatacatccgcgaagcgctggaacagaaagaacaagtcatcctcttccagaaccgccgcggcttcgcccccatgatagagtgcaacacctgcggctgggtacccaagtgcaagaactgcgacgtcagcctcacctaccacaaggggctgaaccaactgacctgccactactgtggctacacctaccaactgccccgcatctgccccgcctgcgagggcactgacctgcgcaaccgcggcttcggcacggagaaaatagaagatgacatcaaagcccttttccccgacgctcgagtagcccgtatggatttggacaccacccgcacccgtaccgcttacgagcgcatcatctccgatttccagcaaggcaagacggacatcctgataggcacacaaatggtgtccaagggtctggacttcgaccacgtcagcattgtgggcatactcaatgccgacaccatgctgaactatcccgacttccgcgcctacgagcgcgccttccagctgatggcgcaggttgccggacgcgccggacggaagaacaagcgcggcagggtggtgctacaaaccaaaagcatcgaccatcccatcatcccgcaagtcattgccaacgactacgaagccatggtaggcgggcagcttgccgaacgccagatgttccactacccgccctactaccgcctggtgtatgtctacctgaagaaccggaacgagaccctgctcgacctcatggcacagactatggccgccaagctccgcaccgtctttggcaaccgggtactgggaccggacaagccgcccgtagcacgcgtacagaccctgttcatccgaaagattgtcttgaagatagaaaccaatgccccgatggcccgtgcccgcgaattgctcgtccaggtgcaaaaggagatggtagcggaagaccgcttcaagtcgctgatagtgtattatgatgtagacccgatgtaaataactcgtaactatagaaatatgaagaagatacttttcgtttgccttggcaacatttgccgttcctcctcggcagagggagtcatgaagcatctggtagaagaagccggacgtgcggatgagtttttaatcgattctgcaggcattctgtcttatcaccagggcgaactgccggacagccggatgcgtgcccatgctgcccgccgtggatacaatctgacgcatctttcgcgccccgtacgtaccgaggatttttacaacttcgacctgattatcggtatggacgaccgcaacatcgacgacctgaaagaccgcgccccttcaaccgccgaatggagcaagatacaccgcatgacggaatactgtacaaagtttacccatgccgaccatgtaccggacccctactacggcggttccgaaggttttgagtatgtgctggacattctggaggatgcttgtgccgggttactgcagagcatttaatccagcggcattacatgatacagtgtcccctgccgtgacttcttgttcggtatttcaagcttcttgagcgtccgcccgaatacggcaaccttgttgattgccagacggtcccgcgtctttgtctgcaaggcggaaagaatctgcatgggcatcatccattgcccctcctcatcctcttctgccgcacggaaatggctgtggaagagttgttccagtggggtgagctgttcaaattcccggttcgtccgcttcaagatggcttcatcggcatcatccagccagtagcgctcacctttggctacggcattcagagcttgtgcatagagctggcggtagttgatggtgacattcgtatcaatggggccggtgacctcaatgcagatgaaacggcggctgccactggggtctgacaacaagtccttctggttgctggtgccgatgaaggaggcataccgccgcatctcccggatggtgctgccgtagggtttgcgcaggttggcaaccggtttctgcagcagatgcttcagaaagccctgctggttgatgttgatttggtcgaactcgtcgatgttgacgagcagaaagcgtcccaggctgcgttccgcttcctgcctgctcttgaagtcaatgctgtccgtatagccgaaacgcagctccggtggcagcaaaatgcggcaaaaggtggatttccggaacccttgggaaccgacaagcagaggagaagtattgtttccgtgttgccggtccattccacgccagtgtgccaccatgcctaggaaccagcggtagaacaactcccgccaatgaggattgtggcacgggacgaggtcggccaacgcccggatgcggtctttcccgtcccagcggccggtatcgtaaaggtattcttcgacgggattatagagtggcacatggtctgaagtaaggaaacggttgatgtcgcggtcccatacgcggataccctccttcagggcattcatggagaccgtactgcgggcacgctggtcagcaggcttgaaatagaaatggacggagtcgcgctgacggtattccaaatcatccagaacggtgttgtagcggaactcataccggcggcccataaactcttccagccggaaaacgctctcctgctcttgcgtcagactgctctttttcccgaagcctttaagctcttgatataggttatgaatcgtttgacgaacaatgaattcatccgcttcccggtaatagtgcatcaatgtctggcggactacttcctcttcggggatgcctgccttgaaacaatgttcggccagaggcaccagcagtatccgtaaatcctcgtcccgtttccagccgtccaattcgcgaaatgcacggtcaagggccgattcgaagagtatggcgaaggtgtccgaggctttactgtccggatgcagccgcaacagcgggttcttttctgcgagttttcgttgccggaagttctcttcctcgggcatgccgaggggttgttccaagcagaaaggcacagcggcaggattgtagtaaggatatccatccagagtcatgcggcaactctgtgtaagggaaggttctttcaatgtaatggcaaacggcagtaagggctggtagcacttcaccgccatacggtaggcgtgggcatgaaacaaggcggcatcgctctcccgcttcggcgttgtgccgtcgggcagggcaaacaatacccatatcttggcactccgtccgctggaaccgcagaaagcggcaaaggtctgtggcagcagggcggcttgtcgctttacatattccgcttcggcaatgcccgacagacggtttacttccagttgtacgagtccgttatagttcttcatctgccgttctccctcttgcgtacggctatattccacggcagggtagatgcgtggcagtttgtctatatgttcgtattgggcgcaagtaccctccagttgaggaaggatggcccggagggtcgatacatgtccggctttggtttcggttttcagttttttaatcagtgcatccgcttccagggtgctgagggcttcctttccgctctctttttctgctctaatcaaggtaattttcattctgtttgtcagcttgtttaagtaaatataattctcgtaaagatacgatatcagaaggcggaaaacaagtattcagtagaataattattaaataaatccctgcttccacaaactatacagcgtggtatcggaaacctttggatttcttttttaaaacataggcattcctttgtttttctccctttgtttgtctacttttgtatagggaatagatgacgcctaacgaccatgaacagctctgcttacggccatgaagcaatcgcttgacgaccgtaagcagagctgtttatggtcgttaggcgtttctatccccaaagcttttacggatgaagtacgtaacccgcacctattccgcatagggcgcgaacgtattgtacaacaacttaaaagacattgaactatggcaattttattcgattggtatgagctcccggaacctaaagacaaacagcgggaagaaaagatacttcatccgcgcatccgcttgaacggctctaccagtactgccgaactgagacgtcggattcaggaacgctgttcgttgacgaagactgatgtttcggcggtgctggatgccttgtcgcacgtcatgggggaagaccttgccgaggggcggcaggtgcatctggacggtatcggctatttccatcccgtactgactagcacggagccggtgaccgctgcgaccaaacgtaaaaccaccaagattaagctgaagggcatcaagtttcgtgccgaccaggtactgaagaatgagataggcgctatcaaagctaaaccactggggctgaatgagcattcccaaaaactgagtgacaaggagattgacaggcggctgacgagctacttctctacgcatcagttccttacgcgcagtgattttcagagcctctgcggaatgatgcgctctacggcacagcttcatattcgcctgcttcgcagcgaaggcaaactcgagaatgcaggaaaactgaaccaaccgatttatgtaccttgcacggggtattatggtagagacgagtaggttacggtaaaacaatagcgttttgagtaggtggaagcaaaatttgcttccacctttttttgttgcttccacagcagctcaaatgccgatggatagggggatgcaggaggtgggtggaagtgtggaagcaaagtgatggaaaataaatttcagagtggatttgttaaaatcaaaataggaggaaaacgttttattgttttcctcctattcatattgtatcaaggacttctcagattaagagaagtaacttgtttcggcttatttcagtactacaggtacattgacagtcttagtcttaccccattcatcaacaacacttactacgatgttgcaagtcagtgtagtagcaggagcagtaacatcggcaatcggagtgagtgtaatctcatttgtgaaattagctgcacttatgttcaaatacttcttagctgtgtcatccaaagctatagaaacattatctacaccagctttagtaaatttgtcagcttcgctatttccgaaatattctacattagtcttagtaacaccacggatttcatctcccttcaaagttatttttgcttcttcgtcagcaactgaaatttctttaggagtacctgccacatacttcttggcttttgtatcatacttcacataatcaagtgtaccttcgaatacagcagacttgatggtcaaggtaaattcatattttacagttgtcaagtaagtattaccatacggagtgtaaatagccttcaatgaacgaggttcgtaagcaccaccgaagttaccagtcttatcgtcggttttagcagccaccttatctacaatgatgtcaccggagttggcagcttcagcatcaacaatccacttattagcagtccatttaacaccgtctttttcatactctgcaggaactgtttctgagaatgtaacatttgtccagtcttctacaccaaacagccccttcaagttgtaattgatcttatcatcaacaggagtaccataagctacagcagcgttaccattgaagtacagaggcagcggtttgaaatcataagaagtagcatcttcttttacaatcaaagtcagcttaactgtattcttcgggcttgaaccataagttacttcggcttcgtaggttccagggaccacctttgtattatctactgagtaagtcaaagtgtgcttgtaataaccgtttggtttttccgtagcattgccagatacaattttgcccgttgttgttatagcttccgcttcagtaccctttgcaaataccactgtgccattagcatccttgacatctacagtaaatttggcattaccaacctcaatcttataagagctaagatcagtagtagtattatcaaacaagctagttaaatcgaataccaatacattcttactattatcggctttcaataccaattcttgagtaaaggcattttcaatagcaggattgataaacttaacggaaatcttcttagtagcagtagggtcaactttacctgtagcagtcaaatacttaacactcactacaactgtcttaccagcaacttcgcccttaatattagttcctgtaatcttagccttagcagcatcagcagcggctgtctggtctgtatcgatgaaatatttcacatcaatgacattctccatatcaacgcaggcactcaagtcaaaatcttgattgatttctgcttctactgttgcttttttaactgtcaaactagaggcaccagcctttgttgcagtagccgttacatcataagcagacagtacttcgttgtcataagcatcttttgttgcaatagcaaaagcttgccccttaaccttatcaatttgctcagtagtaacaccagctgcaaaagaaatagccatattatagatacccttattggctgtagcagctcttgacaaaggtttttctgtcatattgggaacagctgcgttcaaattaaagatagagaatcctttagagtcaaccaattggaatttataaaccgttgcatctgcaattgttggatttacttgagcgttaagtacgccattagcttctttagtaggcaacaagatgtcacctttagcaaacggagtaccatcaaagtattcacctttatctgcagctacaccgtataccaaattaacagttgcaccttcagcaattgtagcattatcatctgcttctgttacagtaacagctttaatgctggaaatagcagcagctctcggcaatacgatatcttcgtaaacaccttctttattcgggatatggatagtcaacttagcaccatcttctacatagtagataccacctgtagaaacacccaagtcttgcttctcgccatccttgccatattgtacatagatgtggccgtcttctcctacagagaaaatcggagtctcagcagcatcacctgcttcacccttcaagtcttccagtgaaataaggtcaatccaagtagtgccattgtcatagcttacttggattttgtcattgttcactgcaattttcggagtcacaccgtctttacctgcttcaccattggtaatagtgtagctggttccattacccaaagtaacaacaataccattgtcagtagatgtcacgccggacacccattcgccgcttttgatttgactctctaaagcagcaatagcatctttgttagaggtaatctgttcttgtaagttgtcgatgtcatcatcatagtccttacaagacgtgaaagttcctgcagtaccaaccattaaggcactgaacaggatcacacttagaaacttcttgttcataattgaaaactttaaatttataaatttaaaaaataaaaaagtgaataatctctcattttcattccctttcacatagctgttgattacatgattttttccgttacttcgcaggtaacggaggaattttccgtgcaaacataatcgttttagttttcgcggaactacactatctgtattctgttgataataaagaatatacaataagtcaaagaattggctaaaacaaggaatactcttttcaaagctgtcctatatgggtctacaataaacaaaaccttacttatgtgataccattaacaaatgtaatattttgattaatagttatttgagtgttaattaatgtactgcagttgtaaaattagcattcctctttttaaaagaatgggtgattatgtcaatatctatcatttgtttatttttcgttgaatatttacttgtattatttatttcatccataagaatattgcatttcatgtaaatactattttaaattacagaataactattcctatttcaaatagagaaagtctgtgtttgtcggataaaaaactaatgaacttatgaggttatttctaaaggatcttaaataaattactttatagttttttgtgtaaaagttcaaaaataaattcattttatacaaatatcgtctttaattagtattatcgtaatgtacactacggataatagtggacttgatgtaaaataataggtgtattatgaaattctatggtcaaaaaagagttggctgttttaaagaatatagcagaacagtttcaagaagaatcgcaaatgccggttttagtaggaagaaggcgcatcggtaagacctcacttttattgaaatcaacggatgaaagaccgacatcgtattttttcattttatgaattggtcgaaattaaacacaatcctgaacggataggttgggggatattgaagaaaaaagtcacaatcaacaaagaatggaaaaactgctctgtttcttataaagggctttctttggaagatatgtaatcttgaaataacacttccccctgaagtcttttgttggattaagagaagaaagccacccatttcgcaatgagtggcttctcaaaaacactttattatgaaattccggtatgttcaaccggatgaatcatcataattgccgcattattattgttggggtaatgcagcttgattagtctgcacagatagcgcttctgtgtcatttttccgtataacatgtcctttgaagtattaattctggtcgctcggagaaagctgagaattattctctatttcagagagaggtaactggtaaaggaacggcctgtcttcttggttataacggaacttaccggcagagaagtgattattattttctgcgccccaagtttcatctgtacgatctacaggaatattcaaacgacgattatcaatatattccaaaccttcaccccagaactctacacgtttctgataaatgatttcctctatcaggtcagccttgttcgtgaaagtgtaattataatcgggctggcgagtcttcataaagctattcagttcagtcactgcttctgcagaacccttgtgagccaaagcttccatttttatcatgtaagcttcttctgagcgcaggtaaatataatctcccagttcccatccactgaacacaccggccttgatattatcacgacctgtaccgataaattttacagcttggtattccacggcaactggagactgagtgtcacgaatcaatgttgtacgattaccggaatcatctgttacacctgtagaacggtcgcagcagaaccattgcagacggatatcagtatccgcgatacggtctactaatggcttaaatgcagcacgccatacaccgatgccggcatacccatcaccataagcatccatctgcgagaagaaagacatataagtcgtactattatctgctgtaatatcacatccgaatactacatccggtaagctgatattactgaatccctggagtatctggtcttcactctgcaatatagggaaattatcaatcaccacttgcgcatactttatcgcctcatcccattcatggataaccatgttcgcacgagccaaatgcatagctactacgcagccatccatatcagtgggtgaggaagtacgcgtcatatccaaatccttgaacaagtcgaaagcagtagtaaggtcactcttgatttgttcatagatttgagctacagtagcacgtggctggtcaccttccgtatcctctgtaataagcggtacgcacggtgactgggagaagtcatatttctctccacgaccccattttgttccatccgcaccggtatagtaagaatactgatataagtaagtcagttgcaagtaggcgtagccacggaaaccaagggcgatggcacgatatttcaaattggcgggatcttcactgctggggtcaataagcttgaggatatcgttggcattggctatgacacgatagtactctttccaacggttgttggttggagtataactctgttgccaatagtccagcaaataatgatacatactcatggcgaaacgtccggtcataatcatatcattgcccatcagcgatgttaagtaatcaaaactcttttggccgaaatagttgtgactcatattgacgtcaacatactgttgcatatcagtatacatacctgccacagcagctgaaaaagccttatcaggatcttcctgagccacattgcccagttggtcttcagtcaaataagcggtaacatcagcatcttcaatgcaagatgtaagcaggcccccgacaaggagcacctgcatcatatatttcattatcttcatatacaattttattttttagtttagaatgtaaggttgatacctccggaaattacacgcatcggagaatagcctccatattcatcatcagaaccagccattgccacacgagggtcaaatccttgacgtttggaccacaagccgagattatctgccgtagcatagatacgcagtttctcaacacccaatttctgcatcaggttcttcggcaatgtgtagcccaaagtgatgttacgtatgctgaagtagctggcctttatcagattgaggtctgactgctgagtgaaagagttggaagcattgtcagcattccaaataggaagtgaaccttgaccggtctcagggttgaatgttttccacatatccttattatgacctacgtagaatgaagaactcatgccggacagataagagtagtcataagcatagccaccaatttggaaagccgttgctatagaaaggtcaattcccttgtaagaaaaagtagtgctcaaaccgccgttgaaatcgggcagtgcagattttccaatgaagtagcgggttgcgtctgcataagtggtggtggtagtacggcctgtcacttcccctttctcgtttgtctcatccatgtaccacatggcatttcctttttcgtctatgcctgcatacatataagtatagtactcaaaacggctcttaccttcgcgcagattgaacggcccggaagtgatgccatctttacggttttcttcgggtaatgtcacaatacggttcttgtagtgggagcctacgagcgataccgtccacttcaggtcaggctgattgaagatatccacattcacttcaaactctataccagtgttcttcatcgcacccagattttcccagttatacggccgtccggctgtagagaaagctacgggacgcttgaaaagcatatcatccgtacgacgataaaaatattcgaatgaaccgtatactctatcgaagagacggaaatcgacccccacgtcaaaagtcttctgcttttcccaggtcaggtccggattaccgtagaactccggtgaataacccaactctgaaccattccaagtaactgtgtattggtcttggtaaggcgtgtatacataggcatagtcatactctgaaaggatgctttcattcccctgggtaccataagatgcacgcagtttcaagtcgttcaaccaagaatttgtaccttccatgaatgcttcgttggaaatacgccaagcagcacctaccgaccagaaattaccccaacggtccaaaaagcgggaagtaccgtcgcgacggaaagcggcagaaacgtaatatttattgctatagtcgtagtctgccataccgaaatacccctcgatgttatggtttgccgtgtagctattgatgtattgcatttgtccaccgttgtctagttccggattgttcggattaaagaagttggtcttctgtcctgccaaatactgatattcatacttgtagtactcgtgacctatcttggccgacaagtggtggttatcgccaaatacattgctgtaagccagaatctggttgaagttggtagtcgtagtgttgtagcttccttttgtaccacgaccaccgaaagactgtccgtcaccgataagcggagtgtagaatactgtctggctactgttcgtgaaatcataactatagtttgctgtaaacttgaaatgcttcaaaaacgagatttccagatacgagcgtgaagtcaggttgttatacacagtttcacggatgtcttctttcatgttggctatcacattctggttagtagccgtaggacgtttagatgtaccgtctgtttcaccatttccggcatcatacatggggcttccatcctcataatatttcatgttaccttctgcatcataggcatgaaccggaaagataggagcccaagatcgtgctacttcgaaaggattggaggcagctccggcattctcttgtacaccattctgagttgctttggaatatcctacattggtacctaccttcaaccaggatttcaactgagagttaacgttggcacgagctgtaaaacgctcataagaagaacctaacacataagagtcattatccaaaaagcccatagatacataaaaatctgtacggtcattaccacccgatgcagatacattgtattcttggcggaaggcattgtcgaacaaggcatcggcaaacgaatcattataacgcaaacgtgcattgggattaagttttccatcaggtgttactaaatattctccttgcgggatgatataagcattgtaattacctagttcgcccagtaaatcctgactggctgctaaattagagtcttcaatggattttccagccgcccaataagtattacgaagaccataccaagacaaacggtagaactcttccggatcagtagccatatcataatctttgtacgcacgctgtgccacaccccaggtaccgttaaagttgatggccaccttgtctttgcgtccggtcttggtagtaatcatgaccacaccaccagctgcacgagaaccatacaaagagttggatacagcatctttcgacacgttcactgaagcaatgtccgtagggttgatgtccgacaacttaccgttgaagggcacaccatctactacaatcagcgcattgttgctggccgaaatagaaccgataccgcgcaatacgatattggcatcttgtcccggctggccggaagagcttacaacctgcaaaccggccacagctccttctagtgcattggacacggatgtagcttgtgaattactgataatctcattctttacactgctgatagagcccaccaaatcttgtttgcgtttagtgccataagccactactgttacttcatcaagtatctctgtatcaggcgtcataaccacttttacgctcggtttgattattacttcttgagtcttcataccgatgtacgaaatcaccagagttttcgcggaactacaataagtctatattgttgataataagcaatataaaataaataaaaagagctcctgaaataaagtaatcctctagagaagatactctatacatatccactgtaaatggcaatctacttatatgatactatttgtaatggtaatatcctgatttataatatattgattctatgctaatatgttatagctataaagtcaggatttctccttattaaaaataggaacacttttgtcaatattcatcatttggttgttttttatcaattatttactagtgttgttcgtaccatccataagaatataaagtcttatgtaaaatactattcaaaattataagggttatgtagatactgtcctacctatcttattcatagggtactatgcaatttcccctattttaaataaatagacaatattacgatttttccctcagatttacattttctggtgaggaagagttattataagaaaatgtagtttacatagaattatgtcaccggggtgaagaatctgtttttgtgatctgcaccgacttccgtatcgtgtagggctattcaggcttgctgtttattggagagaggatattcctattgtcgcaattcttttccataaagtctacgaagcacgatacatgtaagtacacttttagattctccattggataaaccttgtataatgtattcattgtgcgatccaatagcattatgatactgtagtcttaccagtatcataacattcactaatgatatagagctatttttttagagttcatattcatgtatttatctaattgcagacatacgatatttttataagattatgggttattgatagttattgtttttttaagttgattatcgcttttatttgcacattctacagatttaaaaaaagggtagagaaagattctttaaaccatctttttctacccttaaatatttattatttaatttctctatgacttagtaaaagtgtcttggaaagttcccagtggacctgctgaacatgtgtaatctaaaaccacagtaatagtgcgtgtgtcaggattataggaaccaccgtaagtgggattgatattgatataaagcatttgcggttccggcaatcctacgtttactaggcaaactggcgtctccctcattcgtacagaattgtcagcattaactttgaatataatatcatttccttcagcagcaggagctactgctttgaaccaggttgaagcttcgctggtctgaagtacttcacaaggaagtacagcgcctaatcccgagagtgtaaattcacctacacctattggcgtatcccagtaagcttgttgcaacacgctgccggtagtattggcaattgtactttccgaatagctatctatgtccgcttcgtctaatgctacgctgtaagtgtaatattcctcggcttcgacatcagagaatatgatatcaaacgtggcagtgtttgcacctgcggcaaaagttacactttcgggtatgataaaatgactatcattagtagataatgcttttaatcgcgtggtgtgttcgctatctgttttttggcgatttacggtaatggttactttcttctcagaattggcatctataatgttttgttctccatcgcttacaaatgatgctttgatgcagtcagcgttcacttgttgagccggaacgtagtcgcattcttcggtacatgcgctgaacccaagtacaaataccgttgataaagccataaaactatatttaattgatttattcatattttgatttctttaaaaatagaactttagattaatagacttgacttggatcggggttttcatagcctctcaacgcagcattactgtttttctcagtttgtacaatgcagaagttcatccaagcggggcggcgtgtggttttgaattgtgtattggaataaaagttactacctttgtaagtacgatctataggcatatccaagcgtttaatatcaaagaaagtctgtccttcaccccacaattcgacacgtttttggaaaataatttcgtctacaacatcggtaacggagcaaacatatttagtaccttccggagcatcattagccaaacggtatgtattcatgaaattttccaaaagtactttaccagtacctgcagccacatgctcagcggcttcagcctcaatgaagtacatctcttccacacgcatcaatgggtaagctatagctgctgccaaatttacatcatcagggttaccttcaccaggacggaacttgacagaagcataagaaggcaaccaagtgccaaagtttccatatttcggattggcagaagtcagaaagtttgtcttaccatccaaggctgtgccttgaggagccttccacatgcgcttacgaaaatcattgtcgtttatacggctatacatattggcgtctatcattgtgtacggaccgccaacacgttgtgctgcatatccgaaagaagtctcattagacatccatgaagtccagtttacgataccggtttgtaccacatcattttcttttaccaactgtgaaccccaaatccaacagcttaatgtgttgaatcctttggaagtgctaaggcaatcttcttgtgtcataggcttcaatttcgattcatcgatggctttacgagcataagttttagcattaggatagtcttccaaccacatatagtagcgagccatcagaccatacacggcatccagatggggcagcgcacgagaactttcggtaagataaacaatgttttcttcggctgcttgcaaatcagagagaataaattctgccattttttcgcgggtaacgcgaggattgttgtatgattcttcttcggtggtcttttccgtaacaatgggtacagtaagattggtcacatcattaccagcgtcgtttggcatggaagttccgtctgtaggcagatattcatacatacgtgccatgtctaaatacatcagagcgcgaaaagcatgggcagcacctacgtaacctttttctacattcgaagatgtttccagtgggaaggctgccagcaacttatttgccgctagtacatttctccaatagaagttccatacgaattgattataaatatagctttcaccttgatatatgttttcttcccatggccaatagtggtcataacctgaagaagaaatgggcatgtcgccagtttgtacatcacgaatgtgcatgatagaaccgtacccccagtcaaaatgtctactacggtcaacatctatcgcataggtattaagcatagcatgcatagaccacagcatagctccagcagcttcctcagaggaggttacttggtcttcggtcgcagcattggtgggaaatgtttcttcaatacagccagtgtttatcagcatggacgaagagagacaaactccaattagcaatttagatatatttcttttcatattcatttcatttacaagttaattttacaattagaatgtcaaagtaacaccgcctgaaatagtacgcatcggtgcataatatgcggaggttacagcaccagtgatactttgacgcggatcaagtccttgacgcttagaccataaccataagttttcaccagagaagtagagacgtattttttcaatacctgcccgacgacttaatgttgatggtagtgtatagccgaagtttacactttgcaggtttaagtaagaagcgtcagttaagaatcggtctgatgaagctgctgtatagttgtcaccaaactgtagacgaggaatgttagtatggtgttccggtgtccaagcattcaataagtcagcgtggaaagcgcttcctttgctactgctgctgggtgagcccatcatgctggcatagtcaccatcatatacttgtccgccaatttgatagttgaagtctacagtcaaatcaaatcctttataagtcaatgttgtaccaaaaccaccataaacgtcgggtaaggctgtaccacagtcataataagtagcacttgaatagttggtggtggttgtacgtcccgtcaccttaccgttctggtcctttacatctacataatagagtgcttcaccattttcattgacacctgcatatttctggagacggtaagtgtaaaggggcaatccttcgccatagaagtaactgccactgctatatcctccatgtcctcccaaatctagagtcttacgcttttcgggaagataagtgattttgtttttataatgcgtcaagtttaaccgtagattccattccagatcattagtcttaatgggggtacctgttaactccatttccacacccatattgcgcatgtcacctacattggcataatagtaactgtaaccaaaagacggagccagcgggaaagtaaacagcatatccgttgttttgcgaacaaaatattccacattaccggtaagacgctggctaaacaattcgaattctataccggcattaaagttgccattggtttcccaagtaatctccttatttcccatagcatcaggggtggcagcaggagtaccagctgaattttcaataatgtaagtatttacataacgatagttacctatattgtcgtttccttgtgaaccataagaggctttaagtttcaataggttaatccagggcacatcgaagaagtcctctttggaaataatccatgcagcaccggcggaccagaaattaccccaacgatgatctggatggaagcgtgaagaagcatcacggcgataagagccagaaagaaaatatttttcgttatagtcatattgtacacgaccgaaatagccttccgtattataatccgtagtgtatgagttattaccgttctcagtgatggcaccagctaattcatgattagtcgggtcgaacatgttggacttgctggcatataaataatagtatttgtagcggtaagattcatgtcccaacatcacatccagattatgcgaaccaaagctacgtttccagttcagtaattgttgatgattataggccagatttcgggtatggtatttatagagcatgccgttctgactggcatattgcccataataagggttggtaaaagctgtagagcgagtttcatccacatttacactactggtccaagtgaatttgaaatctttaaggaaacgaagttctgcgaatcccatagcattaattgcattaccttcagcattgttttcattcagcatagtggcagaataagcattggaacctgacatgaatggacgtcccagaccgccattctcaccatcaccataatcatacattttatagccatttttatcaatcataatattgccttctccatcacgaatatacataggataaataggagcaatacgggtagaaatggcaaacacattaccagaagaagctgatgaaccgtcttcactcaaagaatttgcattaaaataagtataggccatatttgcacctactttcagccaatcttttacttggtagtcagctttcaaacgaccggtcaggcgctcatagttagaattaacggtaataccttcattgtttaggtaactaacagaagtataaaatgaggacttatccgttccagcagatacattgacgttatattcctggcgcaagccatggctgtaaacttcatccagccacttgtctggacgaattaggtattgttgacctccatattcaacaatattgcccagtactgcattgggattcaatttgccattgcttccgatgaggtattgaccttgaggaacattataagcgttgtaccccaatgagtagtcattgttggcatcatgtgcagccatatttgttgctgcaaagatatgtgcatcattaggagtgtaacctttcgagtttattaaatagttttttaatgcaccataatacatctcataatattgtgcagggttggatactgttttatagtcttgtgtaccacgtgagttggagccccatttggcatctaccgtcacccgcgcttgccctgaatttccttttttagtagtgataataatcactccattagcaccacgagcgccatataatgcgttggatgcagcatctttcaacacggtcatggactcaatatcttgagaagatatattattcatgtcaccatcgtaaggaacaccatcaagaataataagtgggtcattccctgcattgatagaactgatacctcggatacggatagtcggctttgtggaaccaggttgaccagagttgttgttgagttgaacaccagacacttttccactcaaagcattggctacattactactttgaattttgccaatatcttcagatgatactacgctcgctgaacctgtgaatgccgacttcttagcagtaccataagctgttactatcacttcatcaaggagttctgcattatttttcaaaatcacttttaaattaggttttatcgagacctcttgagtctgcatgccaatgtacgaaattaccagagttttcgcggaactgcgcaaagatatgtcggctaacaacttatgtcaaggcggaaaatagaatggttaccgccgttaccttctaatatgtcatgcaaatatagccatttccaatgaattgcgggctatgattgctcaaatttatacttcagtccatactcttccagctttttatagagagttgtcctgcctattcccagtattttggcggcggtgtatcggtttcccccggattgtttcagggcacgcatgatccgttccttttcctccgcatcgttgcgcagggcgaaaccggcggcagcggatgtttccgccaagccaagttccagatgttcttttctgatggtaccttcctgtgcctgcaataccgctcccatgattttttgttgcagctcgcgcacattgcccggccacgggtgtgacagcaatgctttccgggcttcggaactgaacccttccacacggcactccagttccttgttggcaatctcgcggaagaactccgccagtggcaggatgtcctcctggcagtcgcgcaaaggcgggacggtaatctcgaagtcgtgcaagcggtacagcagatcctgccggaaacgcttctcgcttacagccttctccagattctcgttggtggcggcaatgatacgtacattgaaacttctgtccgccttgtcgcctacgggacggtaccgccgttcctgtatggcacgaagcaacagctgttgcgtttccaacgccagattgcctacctcgtccagaaacagcgtaccgccatctgcctcgtggaaatatccttgcgtggcggtgtctgcacccgtaaatgcgcccttgacatgcccgaaaaatgcagacggggcaagttggacggagagcgagccgcaatccaccggcacgaagggcttgccggaacgcttgcttttttcatgcaggtgatgggctatatgctccttgcccgtaccgttctcgccgagtatcagcacgctcatctcggtcggggcaaccaactttatccgcttcatgacggctcggaaagccgaaccgttacgggcgaacacgggcatgtgccgttgtctgccgtcctgttctttctgaatgttgcggagcagcgggacaagcttgtcctcgaccagcaacttggggatgtagtccagcgaaccgagcttcatgctctccacggcggtatgcacctcggcatagtcggtcatgatgatgaacggcagtgccagtccttctttccgcatccaccgcaacaggtctatgccgtttccgtcaggcaggcgcaggtcggaaagcactatatccccgccggaggcttgttgcaggagtttcctcgccgctacaaggcggtaagcctgcacggtacggaacccctcccgtgccagcaggttgcagacaaactcgcaatacacgatgttgtcctctaccacgatgactgttatcttatccttgaccatacttcctcctttcctctttcgccagccggataatttccgcgcccttctccagtacgccgttcaccgcatggaacaatgcttcattgtccggagtaccttcaccgtgcagcagcctgtagagcacctttagcggttggtctgcgcggagtatctcccacgagctgcgcagatgatgcgtaagggcgttcagaccttccaaatcgttacggcatttcgcatccctgagtgcctgcatctccttttcagtctccgttgtcagtttatccagcatggaggcttcgttgccataggacagcagtgaggaaaaatccggtcttccggttctttcccctttcattgcatatcggtcggttacctccatcagctcggaaatcgagaacggcttgaaaagactgcccgaaaaaccgtgcgccagcagttcctccgcgtcgcaactgcccgaaccggtcgtcacgacaactggaatggtccttgaattgcccacgtttgaggagcgcagcagctccagcagctcgaagccgtttatctccggcatattcaggtcggtcagcagcaggctgtagtctttcctgcgtaccatctccaccagttctgccacgttggtgcagatgtcgcaacgcacaccctcatggatatacatttccttcatcatctgaagcgatacctcgtcattgtctatggcaatgacatcccggtacatcggggcgcagcgggcgcggctctccacatccggcatgggtgtctccgcgatgatttgtgcgggtatttctgcgatgaagcggcttcctttccctttctcgctctccaaacggatattgccgccgagcattttcacgatatggcgcacgatggagagtcccagcccgaaaccgtcctgtgtggcggcatttgaaagccgctcgaacgctccgaacacccgttgctgctcctcggcagtcatgcccgtacctgtatcttccactgtcaggaccagcatcccgtccctatactctgtcagcaatgagacatacccgttctcggtgaacttgatggcgttggatagcaggttgttcccgatttgcaggatgcgttccttgtcggttatgacaaaggcatccgcacggttctccaccttcaggaccagccccttgtgcatggctgcgggtgcaaactcggtttcaagtgtttgtgtgaggatggaaatacggcagggggacaggcagggctgttccttgccgctgtccagccggaaaaagtcgagcagcatgtttagcattcttcgcatacgctcggaagactggcgtatgttacgcatgtattttgcgtttttttctggatcgtgttctttctctatcagcccggtgtagccagttatggcgttcagcggggtgcgaagctcatgggtgactgtatgcaccgcttttttgcgcgaggctatcagggcttcgttctgatggatggattcccgcaactgtccgatcagctcggctgtcctgcgcttgtattgcccgatgcggttggcatcgcggtgtatcacgaaaaagagcaccagcaatagcgcaagggcaaataccgccagtccgccgatttgcatgaaaatccgttccctttcggatgcggtctcggcttcctgtcgttgcaggtcttcctgcacattgccgtctatctgccggaccagctgttgcaactgccggttaagcatggcattcctcccagcaagcctgtcggtctgttccgaaagcaacctgtcctgcaggttctgttccgctatcacatggctgttgagcgagtggagcatggcggtggcggatgtgggcgtatcgtcctctttcttaccgaacaaacccagaaatcccttgcgtttcggcttgcgggcggcttcgtccgcactcttccgtgctatggcgggcactctgtcggctatctgcctgtggagggtcttttgccggagatacagtgcggcaagatcattcagctgcgattccttgtttgccagtatcctgcgcaggctgtctattcctttctgttcggaacggaacacgttgcggaaagaacacagcgtgctgtcgataaccatcctttgcaagtggtattcttccttgtcgctgtccgtccattccatgacggtttctccgagaaatgaaagcccggctatttgcatgttgagccggttgatgcttttacgcagcccgttggttgtattattcttttgttcaagcagttccagtgtatgctgttcgttatgaaaaatatatgcaaccagcagcaccagcaggaatatggatatatagcctgctgcaatcagtattcggtatagtctcatgtacgcttcggggtgtcattatcggtaacacgcttgggagtggttattgtaataagccagtcttctctcacaccatttttcatacccttcccgtttcagtttacccggtcttttgagcattctcttgaggcagaaatcgtggaagttgctcttggaaaggaaatggttgcgctctgccacttccttcagggtcagttcgggacggtaggtcatgtcttccatgatacggcagatccgttcacgccggagccattcggtagcagagcagccgtagtatgtctcgaatctctcccggaaatgggaatagctcatgccgcacatgcgtgccatgttttcagccgtgaaggtatgccatttgtacattttcactttcagcatgaatacggccttttccagttccttcatccggctttccgcatactgcatctcaaattctttcagcggtgtggcgatatggcggagcgcgtcacgccgtgccctgaagaaatagtcgcatacccggtttgtcacgcagttcagataggagcgtcccctcatgcagcggagcaggtcgcagaaaaacatcagttctgccgtccggtatcccgcctcatagacggcaacaaggtcgttgctcaggtagcaataggcaaaattttccggtgaacaggctatcagagccatataggacttgtagtcaacctgttccagtgtaggcagatacgggagttgccgcaatgcgtccactgtcagacgcattgctttcgtgtcatgtgcgaaactttccatttcgcggagcattctccgcacggaataccttttctctacgagttcttctgccttgtctgcgatgctgtgcagggtggcggcttggggatttgcttcggctgtccgccttaaaaaatctgtcagtttcattgctgttgtttttgatgcaaagttcgcatatcctgcggttacggcagttccaaatcttgccgaaaactccaacagaagtgcgcttttcagtaaaaaaggaacagtttcgggagaatccttctcatttcaatggctataatacttcgtcattcagcaagctataatagaccaataagaaatacattgcatctcctgcaatcagtgctgtaagccgttgcttgaatttcagatcgtatttttcttccttcaaccgtcttaattcgggaaacagaccgctgaaatcaacgggggttcggctgagtagatagaccggaagaaacaacagtatatccacaagttccttttcgcctctcaccagataaaacggggcaaacaaaagcatcggtatcagttcccaccatcggtaactgacattcctgttcttctcgttctgtttgtccatgcgggctttctccgcacgtgcggcagcatccagccttcgcatgaaggtttcctctttctcttccacgatgtcggctatcaccttgtcatctacaccgcgccggtatagttcctctttcgcctgcctgaccttcttttccggatattctccggtaacattgttggctatcatcagcagctcattggtatcgtattccttgattttcattgttctctaatttaatctgtttcacttccttttccttaagtttcatacattgacttacgagtaagactgagtatcaatatattgactttattagatgagcagttagtccattatatgcttttgattaatatatagtaagttgcaaattgtataattatggaaatcacatagatactataatattgcacatattttttctctttgtcaaattgcttgaaatactttctgtacttgtcgttcttaaataaaaaacatttattgatataatacataaataagcctatggctatccataatgggagaaaaaataaaccattgggattaaaagcaattatcaataagttttttatttttaaagactgaattccaataaggcatataacagcaattatccaaagactaatatgacacacggaaacggtagcataatctgcaacccaaagaattacacctttatgggctgcatcagcctctatctttttactaatcgatataacacgattgatataattattattccatctcttcaacctgatccaataaaatggattaataagtctgtacaaaaaaatagaatttttatatgcacaataataaatcatattatagtatttctccatcaaatctttcattccgccatttttttctgtaagaacaatgtgtttagctgccatctcgatcttgttataaactcaattattaaattttacaattggtaaagacatgacagtgtctttagcattaagtaatgaatggcagtgtccaataaatatgtttcgactctcatctacatgaaaagaatgtatctcatacctcttatgtggagtaacatcaccaccatcaaaactaccaatatatttctctattattccttgtttcttatatattctcttttcattaaaatcatcaaatagggatgacgttacataataacgaattatatattgattgtcttcagctatcttcttggaattgcttgaatagtcaatgaataatatcaacaacacaaatagtcctttaggaactaatagacctataataagactgagcaaatagatacttttatatattcgtatgccatatttgatccctttgggtaatttattaggaatgtgtatgaaaaaggaaaaaatcaaagataacacgaaaatatatccgataatgtatccgatattccatcgtatatgatctgtttctggaactgtacatattactataaaaccaagtattccacataagatatggataccaagaactatatacaataatttatatttcgtcatatttcaatcaatggtttagcggggaacgctgtttagcgttatcccggtttgttagcaactttactttagttcataacaagcatagagttcaattttatttccttcaagaatatcattgatttgatgctccaattcgctcaatccattgacacttgttatttgacggttgaaacctaattgctcaatctccaaatcaagacttaaatgtccgattgatatgaaattatctttcaacttctctacatccgtataatatagagataacttgcgtacaccaaaacttcccatagcattagtttttgttacaggaacttcttctatcaaaatcgtatctattgatggctttagatagtcattgtaagtagtaggaacaaaagcataataagcatctttcctgtattgataaaaatcttcaaatatgaaacagcgatacttgttatcaatttgaaaggcaattacttctccctttgtaaaaagtctatttatgagcgtcttatactttttcggctttcgtacttttaagataggtacacttacctttttgagtaacttttggagtgctatatttctttttgaaatagctatcttatctatttctgcccaagccatatcagctccgttatccactatagttttaagtcggtttacaaagtaatcatccaatagcccaattttccagagcgtaagacatgtagtagaaatataaatctctaaatctaatgaagatgataaattatctaattcattttttagatacgatctaatttcatctgccggttgcccgctatcatatctgtccaatatttcattttgaacatctatgcttaaatcactttccaatatgtctgtaccgtcaatcgccatatttattatttcttttgttgctaatggtttggtgaggaacagcattaagctgttatctcgaccttgttaacgattttatttcacaatcataaattcatttccatatggataaaatttttcatctatccatagtttagagtagtctgataatttgtaaatttcaggtttatacagatttaataccttatccaaaactctctctcggaatattattccatctccatattctacgctatctaaaacgaaaaaattctgtttgattgaacagtctttcagtttcatgtcaggatatactgtaaaacaagtacctagttttttctgaaagtcactctgatatgttatgccttttccgaaatgaaaagaatcgttatcaaaatgacttatacgtaaagcgtagtattttttatccgttagagtttcgtttttcttgtttactaccttgacagttgcaacatcatatttatcaatgaacccattttcttgaagtaaagacaaaaactcttccgatacgatttttagttttatgctccactggtcacaaaaatcaaattgcaaaattcccggtttcttgttgcatacgaggtataagacgggaggcaagttttcttcccagccattcttgtctttccacatccatctccctttagtttgaaatcgttgtcttttactttcatcataagtatcacatacatcaaatttaccatattccaataatcctttaggaagtttatctatcccatatcgccaaatataaagttcttctgtattcataattattatcgttaatggttcagcagggaacggcttgtccgttatcctgcgttgttagcgaaatattctttctgttatttactttgtcaaaatgaaactaaagtagcagcaggctatcgccacgccgtaagacagtacataccagatgaacagtttccagaacttctgcttcctgaacttcttgaagtaggaaatgtatttgtcgttcctttctaccaacctgtcaatcatcaaatatgacagaggcccgcacagaataatataaacaataagcgcaactaactcattttcaaacatcagattatataccggtatatgcgttatcgcctctatcatgttgagcactatatgcaggatgataaagacaaaaagcaaggttgctccgtatgtgccacttaggacattataaactgggaagcccttgcatttttcccacattatactgttatgtgcccgtttaaccccatctacaaacttccagtacctgtcgcttttgcagaatttccgggtgcacgcattgtcgtatatagaaaggaacagatagtccaaactgctgcgtgtcttatacataatcatataattacaatagtatagcatattcataaacaattctatccgtttcattttgacatgttttcgctaatggttagcggggaacggcttgtccgttatcctgcttcgttaataacttttttcttttcattagatatgaaatacctatcgtcaagaacaaataaaaaacaagaatctggcttgccaaccatacaaaaatgaaatcatcaatattgggtggaagatatgcgtcataaagtgaatatttaagtccactccaatatttttgcaattcttctattttgaaatagtaggtataagaccatatattgaaacacaatagaatggttatcgaaatcgctctcaaggctactttatgcaaaataatatccaagattacaaacaataacaatgcgactatcaacaagaacgcttgtaaaaatggggtgaaatccattgttccatttgtatctactatacatatagaccaccttaaaatacctactattattccgaataggagaaaatagactgtatggtatatcttgttttttatgttcatctttaaattgttattaatgcccggcagataatcgaccgtttaggggagattgatctgcttgttaatcgcttttcaactattcgttatttacgtttcccggatgagtattcctccatatcaatatcaaggacaatacggttcggccgtatcaatgcgttttcgtattggcatttccattggatacttgagtccatctgcccgtctttgatgccgtcaacagtttctcccgaattaatttcattaccacttgaaagcagataagaggctacattataggcatgattcactatccagttcggattaaggtcgtgaaaatggtactgtaagtcaggaatacagagagttcccattccgagcgtatcgaccatcatgtcgttggtaccttgaatcgtaaagaaacggacattgacggcataacggataaaacgatccgacccctctatctgattattgcggatttcatctgcctcgaaaagttttccgcttatgttgaagaagaacgcttcacaagacggaaacagttcagcaagggctgcaaggaagtccatttctaaattagcccgctccagcgaaagcagaccgccggcaagaaagtcggttgcgagcatactgtaccgacattcttcaagaatcctatcatgactttcttggcagtcccacatctggcttcttgtgaaatcatcaaccgtcttaccatcaaagttcgtacatgaagtcagtagaagttgcacaggggcttctccgtcttgaaatttcgcaatatggtctaaggcaaagataaataacgatttgtcgtcatctttacgacattctacattgcctatatgttttcggcagacttcagctattctctgtatttctggtaaatccaccgactgtttgaacagcagagttataagcaacgggcctcctggccgctgttctttcgtatctacctcttgtttgaatactttactcatttcgttcttttttcttttaagcgattaatggttcagcagggaacggtttaccgttatcctgcgttgttagctgtatttttgtaccataatcgtagtatttcccgagcagcctgccgtcatcctccatatcgatgtcaaggacaaaacgctccagtttaccgctaccgttcaacttggcctgatgaagacgttccaacatggcaaacccgtcaatgcccggacaacccatgaaccggtagcctcgcacgttaccgataccatccagtaccaatccgctctctgccaacctgggaagatattccagaaacagttcctctatcgtttccggcaagcataaccgcacaacaggcgcaccggtggcaagtttcaccctagtcagccccgtgcctctcacgtccagcttcttcaaccgtccctgccagctcaagtccaaggtcgtcacgttgccgttatccccgttccgggccagcaggttgttgcgcatattaagctcttccagaagcagcataccattagtcgaggccatgaacgagccgttccggtacccgctggctttctccacgctcatgtcaagtttaaccaatgaggtaagcaagccgaaattgaatccgatggcgaacgcgtcctcatgccacaccagctccttgattttggccgcgccgataatcttcagcgggtcgttctcaccgaaggcacgggccagctgcagggagtggagcacgtccgcatccaccacgccgctgtcggcctgcacgccgttgctggtggaaagctgcacacggtacgggatggtcagccggtactgcatcggcttcagtttgtatgccttgtccagcgatgccgtactttggtagaactgggcgcccagcgtagagacataaccgtactccacctgcttcaagtcatacctgcgctggatgaaatagttacggtgagctttcaacgaacccttcagaccgtagatctgcggatacgtctgtttggcaccgtcagcccccaccggcatctcgttcaggaacggatacacatacttgaagatgcctgatttgttgtacagccggctgcaccacctcttcatctgctcggtgtcgaaatggtcaacggccttctggatactgaaagcactcatgaagctggtaccgccgttcacgcccctggtcatcacttcctccagcagattgcccatattgcccagtatcagattccacagccagctgttgtgtccctgcatcacgtaggcaccgtcccgcttcgtctgccggttgtcgtcatacttcccggtcaggaacgacttgttgtccgaacccagctggcagtcaccgtcgtagtaggttatccaccacatcacgccgtcccacgtccgcaccagcatgtttttcgccagctggtccacgcccaggttgaattgcacatacaggtagtaggcgaccaggttgggaaggttgaaatacttcccggcttccttcctgaaggtcgggctcgcccacttggcggtcgggaacctgttgccgtcatcctcatagtccaccccgtcaaacgtgtgcgactccttgttataggtcatgcccttgccggcaggcgtttccttcacacatctgtaaaggaagcccatcatgcggtcaagcgccttgtacatcttgtcatacttgtcaccggtgcccagatgctccttcaggttcggttcctcctcggcatcgcctccgccatcgttccagaacacgtctttcgggtggttgaactcgaaaccgccgtcaaagttgaagtccatgaagtccgtatggtcgggctccgtggacggcagccagcggaacaggcacaggtcgttcgagttgttcagcgtctcgatgcagatgggcaagtattccttcggccggtcaccgttcgcctgcaggtagttcagggtgtcgccggtcccccactgctcgccgccgatggtcttgtcctggccgaatatcgggtagctgtcgctcttctcgttgttcatgttatactggccgtaataggtcagatcctcatccacgctcttagccacgaacaggtcacagggcaagccgtcaatggccgagcgtatgtcttccttgcaggtatccacatggtcggcggcatactgctgggctggggtcaggatacccatctccttcatgccgtcgttgatgaacttcgcgccacccgtgttggtcgtcatggaggaatccgaaaagtcacacttcgcgcaggcgagtttcgcgcccaccgagttgccccgcaggcggaacaggttcttcttgccttccgtagctgtcgggttgccctgctgcccgttaccgtctatctcgccgtagctcatccgtgccgtgtaaccgctggctgtcttctggaagtagaagcgcaggttcttgcgggcatagttcaccgaactggtaccctggatacgcaggtagatgtcacgggctatccagtccagcgcccggttctcgccgttgtagaatctcacttcccggcacagcttgttggccttcttgttgttcagctgggccagcgcatccatcacgttcagcgtgtcgctcccgctcggcacctcactgcccacgctgcccgtgcctatcagtaccaggatcgagttccgccgcttcttcatcagccccatcagcttctccatgctcaccgtgtccccctcgctgagcacgcggttgtcctcgtcgagcgagcgcacgcccggctccccgtcggcatcctccagatggttacggtccacgatgtagttgttaagcacctcgtcagatgtcagcgccttgtcatagatacgcacgctcttcacgaacaagtccgcgcccaccgacttgaattcaagctggctacggatgtcaaagttcaccttgtccaaccacttcgacgcggccgactcctccccgttcacatagaagccgatcagcgtccgctgctcgttcgtctgcacgttcgggtagaacacataggtaatgcggatattcgttcccggctggaacttcgtacccaccgagtcctcgtagcgcagcacctgtccggcatccatcgcctccgtcaccacgccggtaaggaacttggcctcctccggggtcaccaccagcccgtaacggttgccgttatccagctgtccaaggcaggtgatcagctccgcattcgtgtccgtcacgttggccgtgctgtattctatctccagtgtcatgcccacgtcgcggatggcaaacccctcgggcttgtccgcctcgttgaacgggcgataaccgccgtctgccgtcagggtcatgcccgcaccgccggccagcagcaggcggtccttgtgccagccgcttcctgcgccgtattcgttcacgctccaaagcacgtcccggaactccatgcgcttgtctccgctcacccagcttgccgggttgttttccgtgttgcttcgcccgaaggcatcgaacgtacacacggcatccggtgccagcgtggcttcaatgtcggggtgcgatgtggtgttcacctgcacctcaagcacggcatcaccgcacgacacacggtaatccagcggttccacgttcacgttcgtccgcccgtagttgccggtctcaccgcgctgcagcaggtcttccttcaccacactgccccggtcggttactttcacacgggccgtgtacgcatcccgctcatagccggcataggtaaagttccacgccgtgaactgctcggcctccagtacggggtacttccaatcacgctggaaccccgctgcccggtggttgaacatcatgccggcataggccgtcacaccttccccggctttcagcagggtcaggtagtgtatctcgctcaccacgccggagttctcgtgcagcgcataggcttccaccacgttcatgccctcccgcatttcgctcaacgcaacggtgacgttcttctgctggacaccggaaccggctgacaggccaagcgtatagggctgcccgccgttgatacggtagtagatgttcttctcgccactcgttcccttagctgtaaatgggatgttcacgtcgttccggtatcccccgtcagccagtccgttcccaaccgaataagtggtacttagttccatagccaccatcgtcaccctggcggtagcggttttcatcagcgtaccgccatcataaccggtctgcgcctccacctgcacggtgtaggtcgtggcatccttcaggtaaggcgacgcgtcaaaagtatagctctgagcggccgtaacgccgacaaactccgcatcctggaattccgaaaggaccgtggagccacgttttacgaccaccttggccttcaggtcgctgtagccactcacctcgccgccaccggccgtgcccacgccaacggcatatctcaccacgaaaccggtacccaacgacaaatactgggaagcgggcaaggaggaacccgatgcgtcggtcaggtctatattcaccaccaccttgtcatcgtcgctatacttggaaaagcgcaccaccctgtcgctttccccgccttcgccatccttctgcgtgactgtcatcacgtactgagtgccgtcctcgctgtccgtcacgtcgatattcgtcacggtgcccaccagcgaggcgaacaccgcgccgctcgtgggggctttcgtctcaccggcggccagctcctccgtaggggtggccttgtcatcaatacttttgatatagttctccaccaaccggccgctcaccggaagattacccgtggattcgtcaccggaccaatcggtcttctgcatatccagaccgtcctcgtcatatactttctttgccatatcgttattctttaaaagttatttcatccgtttccagccatccgttcggctccaaggtttgtcaccgcgccaaaagcccgcgccgaaacagctccggatggcttgccaaaccagcctggaccctatatagaccgtcgccaccacccgttcgcctacacggatggccgtcacctccttgtttccaacacttatcatacctattcctcctcgtaaatcaggtaaatggtcttgccgtccttttccgggagactctcaaactcctcctcactcatctccttatgtttgtagccttgggctatcgcgtcctcggccttcttcgcggccgcctccgcctttgccgccgattcacccgccgtctgaatggccttctttgtctcccgggtggccgcttccatttccggggccagttcctccaccctttcagcggccttgatcgcccgggccgccgcgtcatcggccggcttgctgagcagggtgatcgggacgttcaccagcttgtcatctttctgtcccggcagggatttgaccccgctcagcgaacccacggtttccaaagactctacactcttcgattccgccttgaccgcctccaaaacctgggcgatatccgattctgtcagtgccatatcaaacccctccctctatcagttcataaacctggccgtaaccgccggccgtcaggctctcgccgcatacctccttgataagcgtaccctcctcggtggtgatctccaggattccaccgccctggatgatacgctggcacaggacgtaagccttgaacttctcatcacggcctaccggtttgtctttcccgtaattgaacagggcctccgccacggcggtggcgatgttgtcgccgccaagctcgttcccgtcaaagcccctgaatctactgtttaagtcaactttcatatctcttggttttaaatgtttattctttgttatatcctacgatgatacctcccctcacgataaggcgtatcttgtcaaggtcggggttttccgacatgccaccaccccagttcactccctcgttatacacgtacgtaccgtcggaattacggctcttgatgtaccggaaccctttcgacgcgcaaacatcacttatcaatccgttaccggtgtccctgacatctaccggaccgacaaagaacccggcataggtcatactaccgctggccgggtaggtcaaggagcctgtcgacgcgtatatggccgccccaccggaggtcgccccgaccgacttcacgccgaaccgcccgtcggtggcaccattgaaggccacgtccacgactccctccgtcgaggaactcgagactcccagtttcaaactccgggaatcgtttccgaaataatcgcggctcttccaatacagacggccggaatcgatggtaaagccgccgatcttaccgccgctcgccttgacagtaccgctgatgttcgcgttccgggtctcgatactcccgtccgtgaggaccttgaaatagccgttagccgtaacaagcccctccagtttgatttggtcggctttaatggtgacaccggaaacaagattgccgaactcgtcacgcttgacatagaccttcaaatccgcactctttacaagcccgttgcttgtaacgccctcagcgaacagcttggaaaaattagcggtagtcaccaacccggatttattccgcaattccccgttctcatcgaaatggacagaaatcagcctgttatatttggccgtcgtgataatggaggatgcctccagcacattgccgtccttatcgaaattcgccgccgcgattcggatcatcttctccgactggtcgaagaacgtggcatacttgtacgccagggcatccgtccggtctgtcgagaacaccaacaaggacacttggataacacccgtgaacgacagcttgaagtcaccggtcccgttccacagcccggaatggttgaataccttctccccaccgaccggcaaatcaccgtcgtaagcgaacatgttgaaattctcgtatccgttcttgttggaattgacaaactcgatacgcaggtgtccggcctcgatcaccttgtaatggaaggacaggtagacatagcccggaatgcgaagcccgtccccgttcaactccttgaaatcggggatcgtgcggaaatctccgttcttctgcatgatgtagctgttcgttatcctgacgtaaggaaccttgccggtctttacgacctccacgttgccgttctcgctcgatgctaacagtttgttaccggcaagaatccacttgccgccgaaagtcaggaacgcggccttgtacccgcttatccatttactcatcccctcggtaaacgtggtgttatcgaaaaagctctgctcctccctcacctcgtcgcgcagaccctccacggctgattgtatcttaccctccgtaatttcaaatttcgtcaggatatcctcgccggtcatgaggacgaacgtacctttcaaatatacgttgtcgccatagagaccgttcccgtgtggttggctattcgccgggaaagcgctgtccttgataccgtcaagattacccacccggcagcgcaaacagccgttgaagtttttcgcattcacgccatccagtatgtcaacacgtggctgcccgtcctcggtggccgatatgctgatcaggttctgccggagcgggttttccgtgttacccatcaatacacactcgtcacccgccttcggttccgtcccgccaaactccctctggggtaccgttatcccttccgtgtcgccttccgacacttccacccagtaaccccgaatctccgcccccgtaaaaacggcacagcgcatcaggtcgtgcgccacgaacgtgttctcctgctcaaagatgatacggtaattgttgccctccttggtcacggtcttgatcttaccgttggctgcggatacaaccagctgcccccttacgctgcgaaccgtttctatgagcagttccaaggctaccaacgtctgccggatggtcgccttgtctatcgtgagattactcagccccgttattttatctatccatagctgccaaccctcgccgaacatgccgtccacgaaacgggtactgcggagcaattcccggataacagccgtcagaaactcggcgttcccgtcgccgtcaacattgcctccggattcaccagctttgtaatccccaaaataagcccctttcagaaaaccgatcacctcggcagcggtatcccgatggcgtttactcaggaattccctttggcttctttttgccgagaaaaggttgttgtcggtcggcagcgtattatcgaagctccggataatatcgggaagcccggaactttcggccttggctttcgtatagcttttcaattcccctatactgtcgtttaccctgtcaaatttcgatacctgcagggcgtcgctgatctccaggtccatctccccgggaaggtttaccttacgggtgatcttcgtaatgcggctcctgcggtagccgtcctttgggaaatactcggcactctccaaacgcacacgccggccgacaaacaaatcgacttcctgctgctcgatccacacatgatcggtcggagccttgtaagcggcgatatccagccagtggtccttgttgtattcgtccaccgcagtcgcaaattcctcctctgccagccggtaatacttatccggcatccggatgttccaaaggacataggtgtccccggccttcgggacgagcttgccgcccggaagctgcgtatcatcaccgtaaggccagatcgtgatgatctcaaactcacgggtggcgctatcgaaattcacctcgaaataatggtcgtccccctctcccagcccggaaaggtcaccgctttggaaggagacgcgtttcgtctcaccggccaactcataatcgttaggatcgaaatccatcccgccgtccttgaagtaatagacggtaaaggccttgccctcttcatccgtcacctcctcactgcggacactgcttaccgtgcccacccgccggggatagatatcgctgaaggcggcctgttcgtagtggtcatagataccgtactcgtccacgcccacctccacgtacttcttttttccggggagcatcagacgggggctgccgtacttctcggcgtcgatgttccggctgctcccgatcggaaaaaggcgtgtgtagaacttcgccgtattgctcgtatcccgctccagggaggtcagccccttgccgtatcccaacgtgatctcctcgccgtgttcgcaacggcacacgttcaccgtctgcccctcgacccaccactcggccttgcctcccaccttgccggcgatctccttcaaagcctggtcgcagtacataccttcgtagtcgatcacgataagatcggtaccatccacctgccccaccttccagtcggtaatgttacccatgccgtcgttgatggccttcactaccatcgcgacatggtcacggggcgtggccgtcaatgtaaacaggggattggtgtcgccgtccgttgtctccagcacaagaaaacgcctgatcaggctctcgataccgtacagcttcaggttatactcccactcgctaccgcttttctctttcggggtgtaccgctccgtcagccaataccgctcgcccatgtagtccgtaaagtcgcctacatcaagagggatatgggcataatgcgtgaaggagagcgccagcacgttgtcgccctgcacctccttgctctgcgtcgaactgtcacttgcagccacgtccgcacgcttggccccggctttatcgtatatcgttaaaagcatattcgaatcgtctttgaatggttatataatcggtaccggctcgcggaacttcaccttgaatttcccggcgtggaccccttccttccacaaataggtcagcggggtgaacttcgggctgtccgtgtatttcacgtgcagggtcagatcaagctggggaaacgcgatgtcgagccacccgtccttccctttcttcagaaaattgatgaacgcgaagtatttccgcagccatccctcctttgtcttgttatacagggcaaagtgcagcgtcacgtcacgcgcctcgttcctcggggtaaggaccgcgctgtatttctccccgtcctcctcccgtatgtccacggccgtctccttcttcgtcttgctcggggtcaggatcgccgagaggttatccatgccaccgcgccggtcctccaccaggaacacgccgtattccgtccagatgtccgtgccgttcaccagcaccatttaccggccagcctaccaggttgcgccatgttcatactgcccaaggcaaggctgcccgtacggaagtccgtacatactcctatgaccatgcaggcaggttgttgacggtgaagcacaagttggatgctttgggagaggttacgctcgtgaacaatgtctatgacgacctgggccgtctacagtcgaagtcgctgcatggcagtgccgtaaacaagcagacctatacttacaacatccgcggctggctgacgggggtcagcggaagcaagttcacgcagaatctgtattataacaccggaaacggagtagtgaagtacaacggcagcatcagcagcatgacctggaagtccgggaacgaaagtacagtccgcggttacaaattcacttatgacggtcttgacagagtactgaacgctacctatggcgagacagcaagtatcagcacgaatgcgaaccgcttctcggagaacgttacggggtatgacaagaacggcaatatcaagggattgcagcgttacgggcaactctcttcaacctcctacggcctgatagacaacctgactctcaccctgaacggcaatcagttgagctgtgtggaggatgcggtgagtaccgctgcatacggtacaaacactgcctttgtgaacggtgcaagcgtcgcaggggagtatgcctacgatgccaatggtaatttaacaaaagatttgaataagggaattaccgatattcaatataatgtattaaatttgcccagtacggtatcgttcagtgatggtagcacaatcacctatacttatggtgctgacggcacgaaactgagaacagtccataagataggtagtacaaccacaacgactgactactgcggtaatgtgatctatgaaaacggtactcagaagttgttgctcaccgaagagggttacatcaacctgaccggtacccagcagtatcattactatctgaaggaccatcaaggtaacaaccgtgtagtaatcaaccagtcaggtactgtggaggaaacgaaccattactaccctttcggtggtgtgtttggcactgcaggcaatacccagccttacaagtataacggtaaggagcttgatacgaagaagggtttgaactggtatgattatggggcgagacattatgatgctgcgttgggaaggtttacgacgaatgacccgttggcggagaaatattattcgatgagtccgtatacttattgtgccgataatccggtaaagttcatagacccaaatggtatggaatatgctcctggtgatctgtttaagactaaaagagcagcagctaaagattggggtatgtattataatggtgcatctattatacgtaaacgtgaaatgggctcttctatttatgaagttaagcaaaagggaaagctaaagggatattcttatagtgcagccaatgaaggagagcacagcgtatctataagcttacctcctaacggtgagagatttgtaggatcgattcattcgcatggagacgcggacgcagagcatataaataataaattctcaaaagctgatataaaatatattgagaaaacaaaagaaaatggttatttggctacgccgagtggcgatttgttagaatataatccttatagtaagaaaacatcaatagtgactagtgatcttcctagtgatcccaaagatcctaaacgaaagaataatattaatccgaaagatattcctgctgaaaagggtaaacaaagaatgaaagaattgctacaaaagccagatttaaacattcctgttagccagagagaacatattcattgggtattttaaaaagatagcaatatgtataggacttatttttttgctttaatgctatttgcgatgtcatgtacaaacagtacatcgaaggtcggagaagatcaacaatcatctcaacagattgagtatgtaatgaatgatagtctctcaacagatttttatactgatatgaaaagctatgttcctgcagagggatttatacctacagcggatattgcagtaaagatagcggaatgcgtactattggaaatttatggaaaggaaagtatagagaaagaaaaacctttttctgttaacttggtaaatggaatatgggtaatagaagggcatattcctaatggaaatgatagtgcgctgactttctgtggacaatcttatgtggaaataagaaaaagtaatggtgagattataaagcttttgcatactaaataaaaaatattactctaatataagttgccttttttcaatgagatttatttaattactatcctaacatcagatatgctatatcttgtatgttaggatagttttttaggtctatcaaatgatgtaggtcatgcaggactacatccgtactctccggatgcttaacagcacgggcacttcctatctggataacatttcctatatgtattatttgtacgacagtctgggacggctgaccctgcaggggggaatccttcttccagtcctaccgtgcttgtgcagaacaacttgctcagtggctacgacatcacaagtacggtttatactttctccaacaagccgtctggtgtgacacatacacatactgccagcggaaagaccacgcgcacggaagtatatacctatacctacgaccatgcggacagaataagcaaagtgcagcatagtcttggcagcactgcgattactctgtacgatgcgacttatgacaacttcggtcgtttactgaccaagcagtatcacggtacgagcaccaacaagctgacttatacctacaacctgcgtagctggctgacgggaatcagcggcacacgcttcacgcagaacctgtactacaacacgggtgtgggtactgcgaagtacaacggcagcatcagcagcatgacctggaagtccgggaacgaaagtacagtccgtggttacaaattcacttatgacggtcttgaccggatgctgaacgctacctatggcgagacagcaagtatcagcacgaatgcgaaccgcttctcggagaacgttacgggttatgacaagaacggtaacatcaagagtttgcaacgttatgggcaactctcttcaacctcctacggcctgatagacaacctgactctcaccctgaacggtaatcagttgagctgtgtggaggatgcggtgagtaccgctgcatacggtacaaacactgcctttgtgaacggtgcaagcgccgcaggggagtatgcctacgatgtcaatggtaatttaacgaaagatttgaataagggaattgccgatattcaatataatgtattaaatttgcccagtacggtatcgttcagtgatggtagcacgattacctatacttatggtgctgacggcacgaaactgagaacagtccataagataggcagtacaaccacaacgactgactattgcggtaatgtgatctatgaaaacggtactcagaagttgttactcacagaagagggttacatcaacctggccggtacccagcagtatcattactatctgaaggactattagggtaacaaccgtgtagtgatcaaccagtctggcactgtggaggaaactaaccattactaccctttcggtggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcaaccagtctggcactgtggaggaaactaaccattactaccctttcggtggtgtatttgccactgcaggcaatacccagccttacaagtataacggtaaggagtttgatacgaagaagggtttgaattggtatgattatggggcgagacattatgatacggcgttaggaaggtttacgactaatgacagatttgccgagaagtattattcgatgtctccgtatcagtacggggcgaatagtccggttgttaatattgatgtgaatggagatagtattagaatttgcactgaaactcagtcctttggtcacacatggattagtgttggtgaaggatctaatatgactgtttatagctacggacgatacaatggaactaataaagggccagatagaagctctaattctttaggaaatggttccggtgttcttttaaagttaatgggggatgaagcaaaagcttacaatgacaaaaaaagcagctggtggaatgtctgtatttgtagtaacagatgtggcagatgaaaaagttgctaatattttagacgaaaagtttaattaatatgtcaactacaatgccagataatcctaaaagtgattattataacagttcttctgctcgtattattgatgaatataagctgacaagtaataattgtacaacaatggtatctgacgtgttgaataaaagtgggtcaaatgctctgaaagggacaaggctacaacaaacaagtaatttgggaacatggactactattcctattgtcaacagatttgttcttccaatatcaatgcagaatcatttagtgagaatatccaaaccaggaggtgtagtttataaaacaagatagattatgaaatggcttagaattgtgtttgttgccacatcaataattctttcattattaattatatacgcaattattaattgtgaaattagttataaatatgagattgaaaatcgatgtggggataagattgatatcttatgggttgaggagtggctaaaagaaacgattaaagtgtggaagttttttctatgctatgtaatcattaatatcttttatttagtagcttctcttgtcaatagccgtaaatcttcaaaagaaaaatgcagtttatcataaacaaacgcagtctcttttgtattgataattaggccgtcttgccttgatatgaattgactatttttatcgttatcctaacatcagatatcccatatcttgcatgttaggatatttttttgtcatataacagtcataccatttctaatgttgtaactatcctccgtgccgggctacacccttttttgcagatggctataccatcgcatagaaagggtgtagccatccggagtaaaaggtgtagcctcgtgaaatgtgtcctacgaatgcttttggcggggataatagcggcttgcatagaatctgtgttcctttgtccgcgtcttgtttttatactgcttcatccgaagaagaaaaggaagcgcaagaatctacggtggcagataacattaccccgacagtataacatatcatatccgaccataaaaatccatgcccgaagaccaatgctccgagcgtggtgtttcgtatggcattcgcccaatcgacctggtataattggctgatttctacgcaataagaaaacagtaaggagattgcggccactttgagtatggatgccgaagggaagagaaagcgtaatccccaatagaccatagctgcccaaagtgtatcgccaatatactctgcaataaatttaggcaatgcattgccatatttccgggaagcaagtcctgccaatatgatgacgaaagtgacggttaagtaaatccaacgtttgtatttcacatcatgatgttttaggtccattgcaaatttatggaaaattgacagatatgagtgagaaggaagagctttttcgtattttttcctatcgaacggtctgtgtaaggctataaacagaaaagcaaatgaagggcaatactatgacacgtatatggccaaaaataactattggtacagcatgcatgaactgagccgcatggacgatgaaacaggcgaccccttgccgggtgaccggagacttgcacctattcccgtcggatttaccgttcggagcggtggcacccaatggctgttcgagaacagcgtccgcaccacaaatccggaagaactttggaaataagactctcttgtttcaaatctccccgaaatcatgtacctttgtggcgatacctaaaaaagggtgtggcaagatgatgaacaagataaattccgtatgcgtatattgtgcttcgagcacaaagatagattccgtttatttcgatgcagcccgtgagttgggcactctgctggggcagcggcaaattcgcttgattaatggtgcgggaaatatgggactgatgtccgctgtgtccgatgcggcactccgggcagggggagaggtgacgggcgtcattccccgcttcatggtggagcagggatggcatcacaccggacttacccaactcgtggaagtggaaagcatgcacgaacggaaaaagacaatggccgacttgagcgatgccgtcatcgccctgcccggtggttgcggcaccctggaagaactgctggaaatcatcacttggaagcaactcggactgtatctgaacccgattgtgatactgaatgtcaagaactatttcgaccctctgctcgatatgctccggcaggcggtggacgaaaacttcatgcgcgtgcagcacggtgccatctggcatgtggcgcagacaccgcaggaagccgtggaactgatatataccactcccttgtgggacgcctccatccgtaaattcgctgcaatatgatagggctgttgatggcttgggcagtagtggggacggaggggattcctattccatattctccgagaatggacgatggcatcaccgtggtccttttgtgctgtttctttctgtcggcctatgtcttgtcacgcagccgcaagttcctgctgcaactggtgaaggatttcctgcttcatcgcgaacgtaccagcatatttgccacttccacagccgccgatatgcgctatctgctgctgctcatcctgcagacctgcatcctagcaggcgtctgtatcttcaactacttcaatgatatacagccggaactggtacaccatgtgccgccgggacttctattggggatttacatcggtatgtgtcttctctatttgtgcttgaagtggatgctttactcttttctgggttggattttttttgacgaaagtgttacaacgctatggcttgagtcctattctacgctactttattacttgggattcgcccttttcccgtttgctctgttcatagtctattttgatttgagtttgcagctgacgataataatcggattgattttagccttttttgctaaaatattgatgttatacaagtggttaaagcttttttgtaacaatttatatggcggtttacttttaattttgtacttttgtgcccttgaaatcatgccttgttttgtgttatatcaaggtgtgatgcagctaaacagttatttgataataaaattttaggacgttgaaaattaagaaagtacttgtgtcgcagccgaaaccggcatcagagaaatctccttactacgacatcgccgagaagtatggtgtgaaaatagattttcgcccatttatcaaagtggagagcctttcagcgaaagagttcagacaacagaaaatttcggtcttggatcatactgccgttatttttacttcgcgtcatgctattgatcatttcttccacttgtgtacagaattgcgtgtgacaattcccgaaacaatgaagtatttctgcgtgacggaggccgttgctctgtatatccaaaagtatgtgcagtatcgtaagcgtaagattttcttcggaaacaccgggaagattgacgatttgataccttccattgttaagcataagactgaaaagtacttggtaccaatgtcggatgtacacaatgatgacgtgaagaatctgctggataagaataagattcagcacacggaagctgtcatgtaccgtactgtcagcaatgactttgctgcagatgaggcttttgattatgacatgctggtgttcttcagtccggcaggcatcagtgccttgaagaagaatttccctgattttgaccagaaggaaatcaagatcggaacattcggctctaccactgcccaggcagtccgtgatgccggacttcgtcttgacctggaagctcccagcgtgcaggcaccctcaatgacggcggcgcttgacatgtttatcaaggagaataataaaggaaagtaaaaagagagaaataaagagagaaataaggattagggattaaggataaaggatgaaagaacctattgtaaccattctattttccgccttgacataagttgttagccgacatatctttgcgctgccaatagtaaggaggctatcattaatttacttttcattttctcttgagtttaaagattgataactacaactgaaaatcaattagtcagcaattataataccaccacctgcgttgccatcatcaccatgaccatgtccatgaccatgagattgaggagcatgattatgacccggaatcggctgattaactttaatatccaaatctgtttttgtatagttatttactacagcaataccaagagtgacatcgccagcttttgttgtagcatcagtcttcttaataatcttatactcagtatttacaacagtatagacagcctttgcttctgtttgagaatgagcataaactttaacattttcttttacagcaggttcttctttatatgtatccttgagagttgcaaagaattgattaacaagcatcttatcttcaaaatccgttgcatcattcttagtagacactaccttattccccgtttttttagtgtaacgtatggtagtggtaagccaataatcactaggattggcaacagcgttcttgccatctacagattccttttcatcagtagtagattcttcaacttcgatttttgtttctgctgtttccttctgaagaatgatagtcggagtcaaagaagcaaactgaccagcttgcaattccggaacatcaactttgacttctacactcatatccttataagaagcagtaaccgtagctttggttgctgccaaagttggattaccagtaaacgtagctgacggactgatagtgaccgtagcagcagtagttacatcagttgtaacgccattctctacggcaagtacaatcggactgatagtagcttgcgcattgataggctcaatatttacattgaactcttctttttcacaagaagtgaaagttgtagctaaagctactacggctaacgcaaatactgcacttatgccgtttaagaatttaatctttttcatctcaattaattaattaaaaatttaacaattctgacttaataaaatatgggttaaaactattttcttccattatattatcacttgcctctgctttgtattgcttataataagtcctttcattacccgcattatatacaacgcccatattggcagaggtgtttacacgcggtatataccctcttctcttatacttataaggaggcaatgccacctgaaaccggaatcctccattcgctttggcatgctctgctttcatagcataaaagcctatcgaacaataacgaaaatgacgagccatttcaaatctgacccccttttccttcattagatattgttcagctttcagtgtgaactgagtattgaaccgcggccaataaaagctcccccccaaagaccaagtggcaacccatgtagaaggatcataatgcaatttaaatccgtcccaatatccagttccagtatatcctattcgagccagcaaagaaaatctctcatcattaaaaggcctaaataaatctacatcaaatccatactgatccgcattaaaatacccgacagtagctttaccaaacacattatacggcaacctgaaacgttgtgaaagagtcaaatttcccggatgaaccttaccttcatattttccatatccatcattataaaccggtattttcaactgtgccgttaatttcatacctttccataacgaaacttctatcgcaggactcaaatcaaacaagacctggtaaatctgtgtaatcaccagattcttgaaagctaattgaggatataccaatacatcaatcttgaacaaagaactatttttcaactttatttttcgtgcatttttccaagtatcacccaattcatagcttacattccagtcatcacgttctgcttggagcaccgaatctccctttatgggatgataataaagagaaatctggggtacattattatccagaactattatgcggcatgacttttcttccggtaaacccatcttttgaataacatccaccgctttgcctatgcctacgccttgcaaacgatatgcagagttctgcagaacatacacacgttcattgccatcttctgtccatccaacattttcaaatcccatttccactaaagcatctacagtactttcccccgtttggcaaatcccttttaaagggagcaaacagtataaaaagaacgctgcacacagtgctattgttttagtatttaggcactttcttatgttagagtttttatacctcatctttttcaaccattttttgtgttcgtataacacaaaatatgctgcaaaaatagacacatttttaataataccaaagatttttatatgaaaaaatgaaataatgttgttttttcttcaaaagcccccaacaaatactcagaatgtttatatgaagtatattagctatcttaaaatccttaatatagctgtgcataattactatacagaatgttgttttttgtgccaaatagtcatttttcagatgtttttgctaattcacttttctctgaaaaaggataaatagaagaaatatctgcaagaattaaagagaatgacaaattgcacttcgcatttaaccaacccctatgatatattaggaattaaatcaatagctttctttttactttcatctacaagctttgcataaatttgtgttgtttgtatattggtatgtcccaatagtttggagaccgtatataaatctactcccagtgtcagcatcattgttgcatgtgtgtggcgcgctgtatgaaatgttacatgctttgatatcccagcttgttcaacccatttgtgtaaaattacattacttctccccagtgagaccaatccggcaaacaccttttccgtttctggtgcatttcctctgtctggcagatgttttatggcttccgaacagagtggaagcgatatggcttctttcgtcttcttctgaataatactcaatagtgcattgccattttcatcatagcgtatatcttcccatctcaatgcaataatatcacaatgcctcaacccacaaaaacagctgaataaaaatgctttccttaataaggtattataaaaaggagtatgaaccaatctggtcaattcctttatagtaagataatccctttctgttcgattacgttttggtttgtcctcgttctttatcttattcatcggattaacagttatataatcttcagagacggccctattcaagcagtagcgcagcgttttcaaataatagaattgggtgttaacatgcaatgtcttttccttcttacaatgttcttgttttgttttcttcaagtaatctataaaacccaacaaataagtcttgtccacctttcttagcaatattccattcggagtatatctttccaaatggcatacaacggcatgtatggcacttttccgtactctattgttcacactttgttctgctattaatttcatatagccagtcagcttcatattggacaatctgttatgattaaatccgtaagtttgattatatatttccaaaatcttctgagcctttatcgcatttgccaaatttagcgtctcgacatttctttttttatcagcttgattatgttcagggataatatacaactttaagaattcgtattgccgccttccattcatataaatatccagatatatggattggcatccattaaccaatttttttgttctcacctttattggctcttttaaattcaattgctttttcatattctttaaataaaaacatacagtttattattagtagtaacaaagcagtaacaaaaatcaatcctacaaattgctttcatgttctatcactcttgtctttttttataattaccttattaactatcaaatatttacagtatagggcacagcgttactgaaagaacaaatataataataagccagtaacaattaaactatcaagagtgtggctattgctatggcggcggaaactttctctggaaatttattttccatcactttgcttccacacttccacccaccttctgcattcccctatccatcggcatttgccctgcggtggaagcaagccgaaaaggtggaagcaaattttgcttccacctgcctgaaacgccgaggttttgcagtaaccacctgtttactagcataatattacgtaagagctacataaatcaatcagttcgtttttcctgcattttcgagcttgctcttctacgaaatcggtggatatcgagttgggcggtaggacgcatcattccgcagggactatgaaaggtaccggtagagtgagccattcaagcggatgatttctaactcatggctatgaataatgccgtctaatgtcctttaagttgttgtacaatacatttgcgccctatccacaatagatgtaggctacgtacttcatccgaaaagtcttggggttagtgacgcctaacagtcatgaacaaccctgcttacggccataaagcaatcgcttgacgaccattagcagagttgttcatggccgttaggcgtcattaatcccctatgcaacagcagacaaacaaagagagagaagccaaggattgtctgtgttttagatagaaagcccatttattagcaggtgtaccggaagaaaagtcatgccggataatagttctggacaataatgtacctcagatttctctttattatcatcccataaagggggattcggtgctccaagcagaacgtgatgactggaatgtaagctatgaattgggtgatacttggaaaaatgcacggaaaataaagttgaaaaatagttctttgttcaagattgatgtattggtgtatcctcaattagctttcaagaatctggtgattacacagatttaccaggtcttgtttgatttgagtcctgcgatagaagtttcgttatggaaaggtatgaatttaacggcacagttgaaaataccggtttataatgatgggtatggaaggtttgaagataaagttcatccaggacatattacaatttcacagcgttttagattaccgtataatgtgtttggtaaagtgactgtgggatgttttagtgctgaccaatatggagtggacgccgaattttatcgcccttttaaggatgaacgcttttccttaatggctcggattgggtatacaggaatgggatattggagcggatttcgctatgtatatgatccttcgacagcacttgtaacttggtctttgggcggtagcttttattggccgcaatttaacactcagtttaatctgaaagcagaacagtatttattgaaggagaaaggtgttaaatttgaaatgattcgccattttcgctattgttcgattggtttctatgcaatgaaagcagaacatgcaaagatgaatggaggcttccgatttcaagtggcattacctccttataaatataaaaggaaaggatatatacctcgtgtgaatacctctgctaatatgggcattgtttataatgcaggtaatgaaaggtactattatagacagtataaagcggaagttagtgacaatataatggaagaaaatagttttaacccatattttattaagtcagaattgttaaatttttaattaattaattgagatgaaaaagattaaattcttaaacggcataagtgcagtatttgcgttagccgtagtagctttagctacaactttaacttcttgtgagaaggaagagttcaacgttaatgtaactcctactaatgcacaagctgttattagtccgattgtgcttgctatagaggatggtgttactacagatgtaactggccaagccactatcgcacctgcagagttgacatttactggtaatcctactctggctcctaagagtgttgatgttacagcttcttataatggtttgagtgcaactgttacagttaaggttcctgctttgcaagctgggcaatttgctactctgactccgactatcattcttcaggaagaagatgctgagactaagattgtagcagtacccactacatctacagatgaaaaaacaaaagaaaaagtatgggataatcctgaactttattgttattctatcccttcatttacttatgtagaaaagagcggtgccaaagttgtagaaggttcaaaaaagatcaacacagacgatcttattgaacgtgctgctattgaatctttcttcaatacgcttgaaaatacctatacggaacatgttgcatcaacaaaagatggtgagtattctgtttatgctaactcaagaacaacggcttctataacttatacaattgtaacgactgagtataatgttgtgaaacaagctgtgactaaggctgatgctgatgctttgggttctattaaggttgatgattatactacttctaaattgagtgtcactgaaaatcaggatattcctggtcacggtcatagccacggtcatggtcatggtcatggtgaaggcaatgccggtggtggtgttggtgaacttgattaatagaggttttagttgttatttatcttaaactcaagagaaaatgaaaagtaaattaatgatagcctccttactattggcacgcgacgggcattgtttccgcgagattgattgcggtcgctccactgtgagcgacgctggaatccaccacgacccttttcaaaacgtgatccttgttcttctgccatggtttcttcctctattcctgcgcggttgcgcttttcaaacgtgggcgttctagccctgatagctacatccctactttaagaaagcatagccgggtcacggcgataatccgccagaaagtgccacattgtgcgtgagtccactcgcctgccgctgcgtgttgccgagctttgactgaagagcagtttggaaaaggggaaaggctctcgtgggtgagtatgttgaatttagagtgagcgtgcatactgttttcggttttgcgctttgtgttttgtgtttgtgcacagtggtaaaccccctcttggagtggtggtccaagagggggtttgtttgagttatgttgcggcggtgtcctactctcccacactctgtcgggtgcagtaccattggcgtttgtgggcttagcttccgggttcggaatgtttccgggcgtttccccactactatgaccaccgcaaatgtggtcactcgcttgtgttccactccccccgtgttgtgtgttggggggtgtgggttgagtgtgatttgtatagtggttgcaagcagtccttaagtggttgttgggtttttgtggtttcgtgtagtgttggccaattagtaccagtcggctcgcgagcacattgctgtgcttccacctctggcctatcaacccgctagtctggcgggggccttcacaccccagaggggtgttggaaacctcatcttggagcaggcttcccgcttagatgctttcagcggttatcctttccgaacgtagccaaccagccgtgcacctggcggtacaactggcacaccagaggttcgtccatcccggtcctctcgtactagggacggctctccgcaagtttcctgcgcgcacagaggatagggaccgaactgtctcacgacgttctgaacccagctcgcgtaccgctttaatgggcgaacagcccaacccttgggaccaactccagccccaggatgcgacgagccgacatcgaggtgccaaaccatgccgtcgatatggactcttgggcaagatcagcctgttatccccggggtaccttttatccgttgagcgaccacgcacccacgtgccatggccggatcactagttcctgctttcgcacctgctcgacccgtcggtctcacagtcaagctcccttgtacacttgcactcgccacctgattaccaaccaggctgagggaacctttgagcgcctccgttactttttaggaggcaaccgccccagttaaactacccaccaggcactgtccccaacccggattacgggccgaggttagatggccgcgtgaaccagaatggtatttcaacgacgactccacannnnnnnnnngctggcgcggctgcttcacagtctcccacctatcctacacaagtccaagcgaacaccaataccaagctatagtaaaggtcccggggtctttccgtccttctgcgcgtaacgagcatctttactcgtagtgcaatttcaccgagttcatggtcgagacagcggagaagtcgttacgccattcgtgcaggtcggaacttacccgacaaggaatttcgctaccttaggatggttatagttaccaccgccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcaggcgtcagtgcgtatacatcgtcttacgacttcgcacgcacctgtgtttttgataaacagtcgcttctccctattctctgcgaccccacaacgctcgcacccagaagttgggggaacgtcacggggtcctccttatcccgaagttacggaggaattttgccgagttccttaaccatgattcactcgaacgcctcggtatactctacctgaccacctgagtcggtttagggtacgggcgcgtcatgccctgacgtcgaggcttttcttgacagcttaggatcaccaccagacacccccaaggggcacccccatcagtcctcaccctacgtgtctgccggatttgcctggcagacgggccacaaccttagacacacacaaccatcggtgcgcggcagctaccttcctgtgtcacccctgttaacacgcttacctacaacaatcaggatcccacaacaccttggctgttcaaacccgaaggaatgaacagttgaggtgcgggtggttagcataaaagcttcagtatttggcggtcacaacgcggtaccagaatatcaactggttgtccatcgactacgcctgtcggcctcgccttaggacccgactaacccagggcggataaacctagccctggaacccttagtcaatcggcggacgggattctcacccgccattcgttactcatgcctgcattctcactcccacacgctccaccaaccgttcccagcaggcttcaccgcacgcaggacgctcccctacccacccacacaaccttaggcaggtcccctgcccaggcttttatgtgtgagtgccacagcttcggcggtacgcttaagccccgctacattgtcggcgcgaaaccacttgaccagtgagctattacgcactctttcaaggatggctgcttctaagccaacctcctggttgtcaccgcgatctcacatcctttcccacttagcgcacacttaggggccttagctgatgatctgggctgtttccctctcgactacgaagcttatcccccgcagtctcactgccatgctcaacctaatggcattcggagtttnnnnnnnnnncgtcagtaacccatagggcccatcggccatccagtagctctacctccaccaggcaacacacaacgctgcacctaaatgcatttcggggagaaccagctatcacggagtttgattggcctttcacccctacccacagctcatcccccaggttttcaaccctggtgggttcggtcctccacacagtcttacctctgcttcaacctggccatgggtagatcaccccgcttcgggtccagaacacgcgacaaacgccatatttcagactcgctttcgctacgcataccccacacgggttaagcacgccacgtatcactgactcgcaggctcattcttcaaaaggcacgccatcaccccacaaggctctgacggcttaaaggcacacggtttcaggtactatttcactcccctcccggggtacttttcaccattccctcacggtactctgcactatcggtcatcaagaagtatttaggcttaccaggtggtcctggcagattcacacgagatttcacgagtcccgcactactcgggcacctatcccacctgcgcatgcaacagtccatctacacgactatcacgcactccggtccgctatcccacacggttcaactaccatcacacacgcaagcccctccccggcagagaagagacgaacaagccccacaacaccgcacacgcaacccccgccgagtatcacacgcacacggtttagcctcctccgctttcgctcgccactactgacggaatatcttttcctacgggtactaagatgtttcacttccccgcgttccccccaccaccctatacacgttcagatgatggtaaccaagcacaaccctggttaggttcccccattcggacaccctcggatcaaagctcgctcgccaactccccgaggcatatcgcaggccgcaacgtccttcatcagctcttgatgccaaggcatccaccgaatgcccaacaaaactaaacaaaaccacacaacaagaaaacaaaagatgctcacaaccactatacaaatcacaaacaacccaccacacacaccaccaaccccacacacccctacaaaacaacagggcgcaccaaaaaaaggggcggtagcatgcgagccaaacgctcaacggtgttgaacgtgaacccgacagcgtgtttgcttccacggagcttgcatccctgttttccactaaaaacacccacgcacccacacccaccaagaaaaaccccagtgaacaaatgcgagcacaagaaacacacaccaaacacacacgcgtgcccttgatgcgcatccccaaaaaacgggctccctagaaaggaggtgatccagccgcaccttccggtacggctaccttgttacgacttcgtcccaatcgccaatcccaccttcgaccactccccccaaaacggttaggccatgagcttcgggtgttaccaactttcgtgacgtgacgggcggtgtgtacaaggcccgagaacgtattcaccgcagcgttgctgatctgcgattactagcgactccaccttcatggggtcgagttgcagaccccaatccgaactgagactggctttaagtgattcgctccaccttacgatatcgcaacactctgtaccaaccattgtagcatgcgtgaagcccaagacataaggggcatgatgatttgacgtcatccccaccttcctccgagttaaccccggcagtcccccacgagtccccaccacaacgtgctggcaacatagggcaagggttgcgctcgttgcgggacttaacccaacatctcacgacacgagctgacgacaaccatgcaccacctgcacacccccaaccaaatgccaccacatctctgcagtgtctgggtgcatgtcaagccttggtaaggttcttcgcgttgcatcgaattaatccgcatgctccgccgcttgtgcgggcccccgtcaattcctttgagttttagccttgcgaccgtactccccaggcggggcacttaaagcgttagctacggcgcagaaaccacgggtggcccccacacctagtgcccaacgtttacagcgtggactaccagggtatctaatcctgttcgctccccacgctttcgctcctcagcgtcagtaacggcccagagacccgccttcgccaccggtgttcctcctgatatctgcgcattccaccgctacaccaggaattccagtctcccctaccgcactcaagtcaacccgtacccaccgcacgcccccagttaagccagaggatttcacggcagacgcggccaaccgcctacaagccctttacgcccaataattccggacaacgctcgcgccctacgtattaccgcggctgctggcacgtagttagccgtggcttcctcgtttactaccgtcattgcaatgcattgttcacacactgcacgttcgtcataaacaacagagctttacagaccgaaatccttcatcactcacgcggcgttgctccgtcagactttcgtccattgcggaagattccccactgctgcctcccgtaggagtttgggccgtgtctcagtcccaatgtggccgttcatcctctcagaccggctactgatcatcgccttggtagtccgttacactaccaactagctaatcagacgcaggcccatcctttagcgatagcttacttgtagaggccatctttcttcatcctgccatgcggcaagatgatcacatccggtattagcactcctttcggaatgttgtccccgtctaaagggcaggttgcctacgcgttactcacccgttcgccactaagaattctaccgaaataaaattctccgttcgacttgcatgtgttaggcacgccgccagcgttcgtcctgagccaggatcaaactctccaataaagttttattgagaaagccgattggctctttcgatttgttgttaagaaattatttttgacttggcaaacgctcctctttcaagaaacgctcgcccgcacattcgtttttggttattgttcagttttcaaggttctgcctgccgccgcatttcggcgacttgtatataatagcattccccgttacttctgtcaacaccttttttacaacttttttatgtttttttcaagaaaaaatccgcaccgaaaaatacggtgcggatttatactctttttacttttattgtactttatgacgcatatgcgggaagaatataacgtcgcggatactgctgctgtctgtcaggaacataaccaggcggtcgataccgatgcccagccctcctgtnnnnnnnnnnttttattttttagcggcagtataaactgccgctaaaaaacatcctgtaatttatttatgttctacctcatatttgaaattcgttatctcgggacgcatatctttaccttcctgcgcttctgcggccagaatcgcctgcagcacgatagcgcattccaaccgttttttctgcaatttacagccatattgatatggcttgctgatgtcttttccgttacttcgcaggtaatgaaatcttgttaatttcattaataatcagggaataaggagaaaatagaccggttttgtttggaatagtaaaaatctgttcgttgggatattggaaagaggattggaagtccagaaaagtgacaatgggaaagtaatgaaatgaggccttcaaaaaatggaagtgtatattttcagctcaaaaggttgaataacagcatattgatagaaccgatgtgagctccgtaaagacaacaccattccgttcctcaaaactctgtttgaagattccggaaaatgtgcgacaaatctattctatcctatcaaaagaagtaacgtcttttacaccgtacacactccacttcttacaaaagaaattaccctttgattggcctcgtcaatttttctgttgctgaaaggcttcagataggtttccgtcaccgtgatggaggagtgccccatggcttccgatatgattccggggtgtatctcgcaatggtaagccattgtggcccaggtatgtctcgccgcataggtgctgagtgccgactgcattcccagacactgcctgagtactgccaaacgctggttgaatgccctgagtgccgactggtattcccggtatgcggcttccgtaccttcctcgctctgcaggatgggaaacagatagggggagtcggggttcctgtccgccaccatcctgaccatctgcatggcttcgggtgtgagtgacacggtcagtgcccgtcccgtcttccgccttctgtaagacagtacattcccctgcaggtcccttttgtgcaggtacgccaggtccacaaagggtatgcccctgagcatgaacatgagtacgaagaaaatccttgttctctgctgtgcgtttgggagcgttcctccttgcaggctcctttccgtctcccttaccaggctgctgatgtcggatgccttgagcgccttcttcttgtctgcccgtgtgccggtatacacatgctcgaacagtctgggtacataccgtatgtactttctgtccaccgcccgatgatacactgagcgtaccgtcttgatgtaggtggacacggtgttccaactgcagttcctctgcctgaggtagttttcgaacctcttcagtacggtcgggctcagcttgcgcatgggcattggttgccatttggtgaatgccgagaatgcattcatcgctgattggtagatgtgtgctgtcccccatctgccgccttcccggagttccccgatgactgaggagaacatctcttgtaaggtaatttcatttctgctcatttccaatttatttataaagagtttatcttacaagtatatacaataaaatgaagaaaaacagaagcttataatgtatttttcattttagccagtctttcagaatgcccccaaatatatttcttatatttgcgaaaaaagtcgcattgaaaaaaatcgcaatatgaataatccatttaaattcagtaccattgtagacggtgaatactttacggatagagtatcggaatagggaagagtaagagagatacttgcaagtgaaaatcgcctgatatttattagtccacgacgtttcggcaagaccagcctcgtccaaaaagtaacgaaaggattgtcacgtcccgtttttcagttgaacctgcagttggtaacaggcactgccgactttgccgcacgattattgtggattatgcttcagcaatatcctatggaacgtctggagtatctcatcactcactttcattttattcccaccatttcaaccaatccatgacggatggcatagaagtttcatttcagccgtcaatggatgaaacagacaagaaggtattgataggcttagctgtagagatgagggttccagtcttccttttctacaaggtgtcggcattgattctccaagtactgcctttagcagtttaaagctgcttgggcaacaagatatgtgatacgcaacgaagagtatgaactggatgctcctttctttcttgtcgatatatacaaagatggctatttccgttttcctaagaaggaaaatggaaatagccgtttctagtatggaatatctagcttatatcattttgggtaattgattcttctgcccaatacgtcattgcgcatttcccgttcactacgatagagctttccgtctttcaggaaatagtaagcaggatatccggcaaactcaattgtagcatattccaaattatctgcacttttacagacttgccaagtaccttcataagtcagcgagtcgttaaactggataagtgtggttgaatccgctttaagttcaaagcgtactccttcttccgtaaaaaaagtgccgccaaagggatggctactgctttttccggtacaggctactaacacacagatacccatcaagagcattgaagagtaaataaatcttttcatcttcatctgtttttatttaatcaataaagggtatcccattaaggaataccctttaatatatcagtatctaacgatctttacttatcgtgtaccaggagttccagagttaggagctacagtaatctcataaacattgatgagagttttccacttataaccgtattcaaccgggataaacagcttataagctttgttaaccggagtaccgctatagttgtaataagtcaagactttttctttgtcaccgtcaccatcgatatctttttcttcatatctgatttcaatgtttgcaggcaacttaccatttgtataaccttcttctggttccaagttaccgtcagtcagtttcaagttagtcttgatcttagtaacatccagaatattgtcagaaccagccttcaacggccaaacagcttctcttacttgatagaagtcatacaatgcttttggcagacctgttgtgttttccacaatctgcttgttgtcattccaagagtagtaagtgaatgcaccagttacatcaattgagctaccttcgttcttggcgtcaacgaagttgtcgatttcgcccttcttaacttgcaacggctcaataatatttgcttcgtattgcttaacaatgcctacattctttgcattattgcagagatcagcaaccaagttgatgggaaccatcttaccaaccaatgccttagcagcttctgtcggttgattagtgaaatctgtaacagcatgatcaggaacagcttcttgcaacttgatgttgtacgtcagctcgtctgcgttcaaaaggttagccttgtgatttacgattgttgctgctaattctcccttaatccacaattctgtatcattgtttctcaactcagccttcacttcagtaccatcgttccaaatataagtatagttggcgattcttgccttatcgaatacgaatcttacgccttcttctgcatagtaaatgccgttagcattttcaggcatagtgtggtcaggttgcatcggaccaaaagcaggataatagaacttcgtattagctacattcttatctgtataatagatagcgccagcagcaccttcagtaggtttcacacctctgtcatccaagaaaccgttcaacaagtcagtatagatgttacatgtcgggttagtaccgtcaacaacattccatgccggattagattctttggttccataaacgatcgggttgatgttgaatatcttatattccttttcacctttccagtatgtacccatgtggccccatacattcaaagcaggcatatagacagttcttgtcattacaacggtaatatcagcattgatacccttaggatctttgtagataacagtcttcgtgaacgtcttctcttgctgaccaggccagaacacaccaagatcttcttcgtttaatgtccacaaaatattgtgagactcaacgccttcttccggatctttcaaatcttcagctgtaccagctccctcacctacaatgaattcagtatagatagcatggaattcgttctttgtcataccaccttctttagccttgtcgtaaatcatggtattcatcatttctgtatcgacaaggttcttaactgtacaagagaacaataccgggttgaacggaactgccagttcttttccttccattgtccatttaaccttcaagtaacgttgagcaaccaatgcattgccatttacagagtcgatcaattctacgcaaacaataggctcacgacctacggctgttgcagatccagggatgtcatatactttagcagacattttaccattcatcggagaatcgatttctgcaaatttttgttggtcagtcttgttgtcattgtcgttttcaggaatataagcggcttctgccagacggaaacggaatgtcagaccatagtccttgtagtctaccaaatcctcatgtgcggcatgatcattggctttgtcactaacacaaacttttaccaatttctttaaatcaagaggttggtcataagcttggtaatagtcaactaaagcatttgcatttgattcatacagacatactgagtcatgatagtgaacatagaaatcaccgtttccatcattctgtatttcgtctgcgaattcacctgttatggtttttccaaaatcagttctgctgttagccaaatacggcaatttgataagctcttcaatacgagcatattcagagtttacataaacgccatcaatagtaccagcttcaacatccttagcttcgtcttctgtatagttttctgcagaaataggagctttcaaagaagccatatagaatttctccttattgccttccttagtggtagagagctgttgacctaagaaatcagaatgttttttgaatgtaacttccagtacaccttccttgtcaatattgtgacctgtaacttcgatcgggctattgtttgtaattgttgtaccgtcagcattctttgtcattatattttcagacttgatgcagtcaaatgacggagtcaggatatcttgagtacgaacacctacactcgggcttacatggaaataagccttattcttctcagtagcgatgtaacgggctgtaccggcatctttgtggtctaacacaggacggttagtgtggcccgaaggatcagacgtatgtgtaggcattgcctcatacttctgaggagtatactgcaaagtggtaaaagtcatagcagcaataccgttgatatgctgagtcgggatcagagctagactagtcagacggtgtccaatcaatttaaccacctcagcggtcagggcatcaacctttgcagccaaagcttgtaatttttcgtctgtaacgaagcctccttcaagctctttctttaaatctgcaattttcttgtccacagtctccaatgaggccattttgtcaatttgcttctgcaagtctgcctgcgctttctccagagcggcttttaaggctgcaatttcttcagaagaagatccaccttgtcctgctttgtccaatgcttctttagctttgtccagtgcttcttgtgctgctgttttagcattagaagcttcagttttggcttcagcgatagaagtctccaaagcacttactttagagttcaattcatcaagtgaagctttcttgtccagttgtccctgcaagtccttgatgtcatcatcatagtccttacaagacgtgaacgttcctgcagtaccagtcattaaggcactgaacaggatcacacttagaaactttttgttcataattgaaaactttaaatttataaatttaaaaaaataaaaagtgaataatctcgcatatttggtattactttctcttatttttttgttaaaattttccgttacttcgcaggtaacgggaatctatatttaatcaattgtataaaaacaaacgaacgaagcctccgtatccttatcagacacggaggcttcttctgaaaaacggcgactacctactctcccactgttacgcagtaccatcggcgtgaccgggcttaacttctctgttcggaatgggaagaggtggaaccccggtgctgtagtcacctgaataaggtagacatgatgcgaaaaaagcaaagcattcatttatggctgaacgtatatacctccatacaaggcaaggcaaaaagtgaacgggcaattagtaacgctcggctatgacatcgctgcctgtacacctgcgtcctatcaacgttgtagtctacaacgaccctgagaaatctaatcttgtggctggcttcgtacttagatgctttcagcacttatccaatcccgacttagatacccggcaatgcacctggcggcacaaccggtaaaccagaggtcagtccaacacggtcctctcgtactagtgtcagagccacgcaaatttcatgcgcccacgatagatagagaccgaactgtctcacgacgttctgaacccagctcgcgtgccactttaatgggcgaacagcccaacccttgggaccttctccagccccaggatgtgacgagccgacatcgaggtgccaaacccctccgtcgatatgagctcttgggagggatcagcctgttatccccggagtaccttttatcctttgagcgatgtcctttccatacagaaacaccggatcactatgctctagtttcctacctgatcgacttgtgagtctcccagtcaagcgcccttatgccattacactctgccgacggttaccaatcgtcgtgagggcacctttagaagcctccgttacgcttttggaggcgaccaccccagtcaaactacccaccaaacagtgtccccgcaacagcgggttagaactcaaataatcaaagggccgtatttcaacagcggctccacgaacactggcgtgcccgcttcaaagcctccggcctatcctacacatcaattacccaaattcaatgttaagctatagtaaaggttcacggggtcttttcgtcccatcgcgggtaatcggcatcttcaccgatactacaatttcactgagctcacggttgagacagcgtccagatcattacaccattcgtgcaggtcggaacttacccgacaaggaatttcgctaccttaggaccgttatagttacggccgccgtttactggggcttcaattcaacgcttctcttgcgatgacgtctcctcttaaccttccagcaccgggcaggtgtcaggctgtatacttcatctttcaattttgcacagccctgtgtttttgttaaacagttgcctggacctattctctgcgcctcaattgcttgaggaccctttatcccgaagttacagggtcagtttgcctagttccttaaccgtgaatcactcaagcgccttagtatattcaacccgactacgtgtgtccgtttgcggtacgggtaccgtaaggattaagtttagcggattttcttggaagtatgattacacgcactattggattgtccagaaggacgctccatactgtcaggttcgactctcgttccggatttgcctggaacaatcaacatctacacccttcaacggactattccgtcagtccgcggcgctgtcacgactccgtctccacgtcactccttaaggtagtaccggaatattaaccggttctgccatcggcctcgccgttcggctgagccttaggacccgacttaccctgatccgattagcgttgatcaggaaaccttagtctttcggcgagggggtttcccaccccctttatcgttacttatacctacatttgcttttccacacgctccagcaaggctcacgccttaccttcgacgcagagtggaatgctcccctaccgatgatttctcatcccaaagcttcggtagaatacttatgcccgattattatccacgccaaactcctcgactagtgagctgttacgcactctttaaatgaatggctgcttccaagccaacatcctagctgtcttagcaatctgacttcgttagttcaacttagtattcatttcgggaccttagctgttggtccggattgttctcctttaggacatggaccttagcacccatgccctcactcctgacatagaactgacacgcattcggagtttgtcaagacttgataggcggtgaagccctcgcatcttatcagtcgctctacctcatgtcagtataagtcaaggctgcacctaaatgcatttcggggagtacgagctatctccaagtttgattagcctttcacccccaccctcaggtcatccagaagcttttcaacgcttattggttcggtcctccagatggtgttacccatccttcaacctgcccaagggtagatcacttggtttcgcgtctactccttccgactatacgccctgttcagactcgctttcgcttcggctgcggatctgagatccttaacctcgccggaaaaagtaactcgtaggttcattatgcaaaaggcacgccgtcacactaaaagtgctccgaccgcttgtaggcacatggtttcaggaactatttcactcttctgttcgaagtgcttttcacctttccttcacagtactggttcactatcggtctctcgggagtatttagccttaccggatggtcccggcagattcacgcagaattcctcgtgctccgcgctactcaggataccactaggcttcggttggcttcgcatacgcagctatcatgctctatggctgtactttccagaacattctgctcaccaactttcttgccacaacgtggtcctacaaccccacacatgccgtaacatggatggtttgggctgttccccgttcgctcgccactactgggggaatcattatttattttcttttcctgcaggtactaagatgtttcagttccctgcgttagcctcccgcattgcgggatgatatcccttcaggatatcgggttgtcccattcggaaatccgcggatcaaaggtcatttgcacctacccgcggcttatcgcagcttatcacgtccttcatcgcctccgagagccaaggcatccgccatgtgcccttacttactttttgtcttaccgatcacgtatggtcgatatatactttcagctttcaactttactttttttggtcacatcatgtcaaagatcgttgtcaaggattaaggattaaagataattcctaatcttgagaagtggagaataacggattcgaaccgttgaccccctgcgtgcaaagcaggtgctctagccagctgagctaatcccccttcaccattgatgaaagacccgctaaatcgtaaccggtcggtcaccaactgagaagtagtcccaggcagagttgaactgccgacctctacattatcagtgtagcgctctaaccaactgagctataggactgtcagtcaaaccctcgccttacggctcggcttctacttttctcgtatattttaataaacaagtacgcgcagtacaagaggttcttatggaagcataacttcaagaaccaacgatcgagtcgagacgtcactccagaaaggaggtgttccagccgcaccttccggtacggctaccttgttacgacttagccccaatcaccagttttaccctagggcgctcctcgcggttacgcacttcaggtacccccggctttcatggcttgacgggcggtgtgtacaaggcccgggaacgtattcaccgcgccgtggctgatgcgcgattactagcgaatccagcttcatggagtcgggttgcagactccaatccgaactgagagaggttttagggattagcatcacgtcgccgtgtagctgccttctgtaccccccattgtaacacgtgtgtagccccggacgtaagggccgtgctgatttgacgtcatccccaccttcctcacatcttacgacggcagtctcgacagagtccccagcataacctgatggtaactatcgataagggttgcgctcgttatggcacttaagccgacacctcacggcacgagctgacgacaaccatgcagcaccttcacaaatgccttgcggctgatctgtttccagaacattcatttgcaatttaagcccgggtaaggttcctcgcgtatcatcgaattaaaccacatgttcctccgcttgtgcgggcccccgtcaattcctttgagtttcaccgttgccggcgtactccccaggtggaatacttaacgctttcgcttggccgcttactgtatatcgcaaacagcgagtattcatcgtttactgtgtggactaccagggtatctaatcctgtttgatacccacactttcgagcatcagcgtcagttacagtccagcaagctgccttcgcaatcggagttcttcgtgatatctaagcatttcaccgctacaccacgaattccgcctgcctctactgtactcaagacacccagtatcaactgcaattttacggttgagccgcaaactttcacaactgacttaagcatccgcctacgctccctttaaacccaataaatccggataacgctcggatcctccgtattaccgcggctgctggcacggagttagccgatccttattcatacggtacatacaaaaaggcacacgtgcctaactttattcccgtataaaagaagtttacaacccatagggcagtcatccttcacgctacttggctggttcagactctcgtccattgaccaatattcctcactgctgcctcccgtaggagtttggaccgtgtctcagttccaatgtgggggaccttcctctcagaacccctatccatcgatggcttggtgggccgttaccccgccaacaacctaatggaacgcatccccatcaatgaccgaaattctttaatagctgaaagatgcctttcagatataccatcgggtattaatctttctttcgaaaggctatccccgagtcatcggcaggttggatacgtgttactcacccgtgcgccggtcgccagcaaagaaagcaagctttcttcctgatgcccctcgacttgcatgtgttaagcctgtagctagcgttcatcctgagccaggatcaaactcttcattgtaaaagtatcgtgactgcgcaaattaaaaaaaattaatgtgcgacagcttgttatctgttcaggacgctcgaattcaaaagtttatctttacctatataaaataagtattgacggttctcttgttttacccaaggcaattccccattgataaggaaaagccttgctcttgtactacttgtattgtttatgtaaatctgttcaaagatcgctcgtttcacgattgctgttcttttcagaaagcggatgcaaaggtaagaacttttaagtatatcctccaaatattttcggaagttttttctgacggcacaaattttctgttgaagttcggcgagtttatcgactctatggtcgcgggcaagggtgccggaatattccctgacggccgtatgcagctgtcccgcctcgaggtccgcgacagccttaccgtccttgagcttatcttcaaccgtctctccgccatggagagcgactattcattctccgagtccggtaccatcgaaagtgtatcgcagcttgaagacggcacatacagcctgaagatgaagaagcggtgggataacgactttactgcactggcagaaaacgatgttgtatatggtgttgtcaatgaccttacatcaggtggcggcaagtattatacctcctggctacgtgtcttgcatgttgacatctcagccaatacgatcaacgctgtgatgtaccctgatagcgaggtgccgggtggcaagaattatcctcctgagccgttgatgatattatcacaccgtggcaacccggttgatactgaacggcagggttattggtatctgtcatcccgtgagcattgtatctgcatgcttaacggggtcacaaaacccatccttgaggaaagcaactattcggtgatcgtcggcaggctgaagcatctgtctctgttcgacaacctgcccatcaactacctgcactcttatatctacgttcggggattggtagcgcaggacatccaccgcatcgacttccaaggcgtattaccccgcatcgccaacgaccgcggcgagtggagcatggagaccgccacgggagcagaaccctaccaagccgaccgcgaggcacagaccgagactgtacgtgtgatgatgtacgataccgtgtggcactacggatgcaagtggatgtgtcttgtttccggcactaccgacgaaccccaatacggttccgcatcctgggcaatgatcgagggcaatccggatttcagcatcgatatagaaagctccaatggctggtacttcgatgcggagcgttttgctaccaccctcaccattaccggtgagctgtacaaccgtgacgtgacggcgcatatccttgacagtgatgtggagtggacgcgcgacacgggcaacgtcaccgaggacaacgcctgggcggtcgcacacgcggaaaccggcaagtcgctgccgctgacggtcaacgacctcggccccgactatatgaacatgaccgggtgcaagtttatcgcaagggtgctgctgcgtgacgggcagaataattatgagacaatgaattatataactttctaattatgcagactatacagaagaagatagaggtcaactaccgccctctccagaccagcggcgggatagaggttgtcggcagcgtgccggacgtgcaggtgtaccaggctgacaaggccgagtacactccggactacacgcttacccccctgacgctgttcccccggtgcaatgccaccgacccggatgcggtgaccaaagtgggcgcggtcaacgcgtcattggtcaacatgaagtggtacgagcgcttgaacggtgtgcggacattgattacatctgccaacaagagctatgtcattaccgagaccggagccgagaagggtaagatacaagtgaaaaagaataccgttcccggcagtccggtaacactggagttctacgccgagtatgtcgatgcgaagcgtaccggacagacgcacgtctaccgtttcagccgtcttgttcgcgccgtagatggcagcgaagcacagcctaagctggtgattgattctccttcttctttggattggaatccttgccgtgatatatcaaaacatatcattaccgccaagctgcttgtcggcgatgtagatgtcacagcaaccaacaagtgcaagttcttcttctatcggaagctgaatacgggcgcactggagcagattaccgacggtaacggcgacaatgactgggagttcgtatcactgacaaagaacgtgcttaccatagaccgggactatatcggccacgaacagacctacgttgtgaaagcatcgtactcgaaggacggtgctccttcatccaagccggacagtgacatagactatgtctccaccaccattcgcaggcgtattcccgccatcgagattgactgggagggatttccgcagcaggtggccgacggaaccaagatgatatacccgaaaccggtcatccgtgatacggcagggattgtccccaatccccaggccatccttgagtgcgaatggtacacgaaggtggccggcgcctcctcatacgtgctggccgctgccgggtactcgccctccatcccatgcaccgacggcatgatgctacagctgaaggtgattgacaagggcccgtatgcggcggtggtgacatctgacggcaagtacgtgacggatgacagcggtaagtttatagtggcaaggaaaagggatgtttaaccattaatcgatagcagtatggcattttatatcaaagtgacgagagaggttgcggacaagctgggagtggcaggaatccgcaacagcactgccgacggcaatgtgctgttatggcaggccgatgtggcaggctttcccggcgatacggtattcgaccgggcggcagtagtcgggggcgtgtgcctttccccgcagcaggccaagggtgagatagacggcgtggaagatccggtggaggtcgccactccggagggtttcatggataaagacggggaggaggtgaccgatgagcgtagcgagtaaggtcgggcaggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtggagcgtcagagatcacctccggactgacctacaagtggtccaggatggttaacggtacctggcagacactcgtcgaccagactggcaagagtctgaccgtcacggacagcctggttgacactacgggtatcttcaaggtggaggtgtcgcagggcggcaatctgataggccttgacacgcagacggtgatggacttgtcagacccctacgacatcataactaatcccaatcccgaggatgagacgattgtttccggttccggaggttcggtgacttatacgcctatccttgtcaagcggggacagaccacgaaggcaatgaatatgctgttctattttgtctttatggattcggcaggggtcattctcaatccggctacggcgaatgtggctgcggcaagcggtacctgcactgaagctatgtgccagcaggcaggcggcaatgtttcatggacaatctcaacggcagcatgatatggcaaagaaagcgttggcaagcaagacgggagaagtgaagtatctccagcagggaccggtcggcccactggtctatccgaccggggagtacgcggcatccgtatcctatacccgtaccccactgtccgcacccatggtgctgtgtgaggggcagtattacgtattgaacaaggagggcaccttcaagaatattaatccgaaaaaggactatgcggccaacggcagcaaggccacctgggtgctgatggacaaggtcaggtattcgttcgtcgagattctgatggcgaacttcgcaaaactggcgagcgccgtattctacgggcagtatatgttctcccagtacggggtgagagcggacggttcggccgtggagacggagggcgggtacaaggacttcaattacagtgatccgatgaatccggcgaacgggttcaggccgaacctgctgattgacttcttgagagggagcctttatgggcggagtgttgacttgcagggtgacattacagccgagacaatgaatctgaaggtttgtacaaattcagacaatgaattacctaatggctctataatactttatccgaagaatttggggcctttaccggaactggaagctggcacttgccaggaaatgaagatgttgtttcctattgcgacaagggttcccctttccgtaactttaaccactgcatctgccaatgtgaggattgcgcccaatggctctatacttgattctgcgtcaagttatgatatagtagatgcttacggatatcatgaattaatcgggtttagatatgccgatggggatattacctattggtgtgtatttaaaaaacaaaagagtgtatgaaagttttttataaaagcgaggtggcgaaatggctattgtggtaaggctacagcaccatcacattcatttgattttaaatttacaaaacgagaataaaaacaaaatgttaaactggttgtcgtttttatccgaaaatgacgaccctcaaaagtacaagggatatgatagagaaggtaaacataagtcaagccttgaacagcttatctgttaaggatgatgcagattttttctatggggaaacaagtagtgaaccggtgaagattaagaaaagcgaccttaatttgcaaatgaacaaagcaaatattgttaaagatggagacttaaacaaccttgtagaagctggagaatatagcgtatggaataatgtggcaaacattccaaccaatagcttttattgggtcaaagttataggttcagctgattttgtacaaatagcaatatcctttatcgacctgaaagagtataagaggtcacgagtcaatggtgtttggactcaatggaaatgatttttactactaaatagaatatttcctaatacattctttttcattcgtatcttctgaccctcaaaagtacaaaggtatgatggaaaagattaagttgtcagaagtggagcacaagaagcactggacaaagctaaagaagcattggacaaagcaggacaaggtggggcttcttctgaagacattgcagccttgaagaaagctttggaggatgctgatgcagctctacagaagcaaatcgacaagttggcttctctggatgctgtagacaaaaagattgcagatctgaaggcagaattacagaaagatttcatctccgatgcagatttgaaggaactcgcaactaaggttgaaaaattgagcgtagaagtgatgaccttgattggtcatcgtttgacaagcctcacactgattccgactacacacatcaatggtatcccttctattgaattactgtcattgcagtatactccgcaggtttatgccgctgtaacagatcatcagaatgatgtggtaccgggaaatcatccccgtacgcctatggtagaccataaagctgtagctaatgccaaaactcttaatatttctacagaaaagaatgaggtaagctataagatgagtccaagcatcggtgtgttgaaagatgatattaaacttccgttgttcgaaggtatcaaatctcaaaatgtaactaagtctactccggaaattctggagaatgcccctctcgaagttgttgattatactgttgatggcggtgttttgacagtacaatataagaagaataaagaatatctgaacgaaaatatcggtacatcaggtgaagcacacggagcagataagcttgagacattctggatggcttccttgaaagctcctattgctgacaagaacctgactgatgacgaaaagaaggctggtgaagaagtatatgtaagttctgaatgcagccgtatcgaagaatctacagtattcccttatctggctaacaagaagattgactttaacaaagctatcactggtaactttgctgatgaaacacaagatggtaagtatgtacactatcatgactctatctgcttgtacaaatcaggtaatgatgtattggttgatgttaaacaagcatatgacgaaccgcttgatttgagaacattggtaacagtatgctatacttatgcagaagacgaacatggtagccacaaggaattgagcaactaccccgactatggtctggagttccgttttgctttggcaaaagccaagtatctgcagggtgaccgcaagacagacgagcaggaattcggccgtatcttgtctgatggttacactctgaagtctgaagtttatgacgtagagttgggagacaacgaatattctaagacttctatcggtcgtgagcctatcattcgcgctgagttgtgggataagaataacggtaacatgattgcagttcgttacatcaagattcgttggactggtgaaaaggatcagactattgctgccatcacattcccgaacgacactgtaacttgtcatgacatgttccagcagctgttctctaaggaaatgaatgagaagatttaccacatggttaagttcgatggtggacagagtatgagtaagactcagttccatagcatctacaagggcatcgaaatccttgaacttagaaaagatggtaagaagattgaactcagcacattgacagaatctacagatgctttgagtgactgggaagaaggagcaaataaagttggcaaagacggtggtgaagccatcaagaatactagagatcttgtattcggtttcttgcaggatgctgaagacaatacttctttcaacttggtttgggctatgaatccgaagactgttggtacattggcttacaatgcagcaaacaagacttatgcttctacatttgaaattgatgttaagtacgttgacggaactggtttgaatggtgacatcaagcagacattcaagcagacaattgttgttcctgcacagaagtttgcataccaaggtactttctggaagaatggtaagggcgaaggtgtcttcaatgtgaatccgattgtttacactactgcaaatgacggtggaacacagaaagacccgcatgtatatccgggtactcctgacggttgtgagctgaaagactatagccacatcgaagctgacttggttaatggctttgtatatgaaccgaccaaagaaaaaccagccaacttggcccaattcatccagtatattcgtgagtgtgcagaggttaagtttatctttgacgaaacacgtatgaaagacctgactacttatccgcatttgaaagactttgtcacaagcgatgaccaaactcaattgtggtataagactaaaggtacagcaaaagacgaagtcgtaagtgacaacagcaacatcggtagaacggatgcaggaattaatgattataaacaatctaacgatttggctgccactatcaataacctgatgggtgctgatgctacagaaaacaaaaagaacttgccttggaattatgatgaaaaattaggtaatagcgtaaatgaatgctccagtatcatccgtctccacgaaaaagatgacttgaacggtactgatgccgccctcaagttgattggcaaggaagttcctgtacagctagttgttgcatacaatgagttcaatgttattccagttcaagaatttgaggtacacttcatcaacccgttgactattgacggttctatcagcgacaacttcgttgatgctgaaattgacggtagcttcttgagcgttgccaagaacttcacattcactgactggaataataaaccggtagctgctgctgtagctgacaaggccactggtgatgaagtttatgcacatgctttgtatgactactatgccgtacgtgaggtcaagttcttgactgataagaccactaccagcttggcttggaatgctgcaaccaacacttatgagcacaaggagggtactactgacggtaaattgccgaccaatgcttcattgaagatgatgaattgggatgagtctacagacaagtcaacagctaaaccggtcgatgctgacccgactcacttggcatacttcaacaaccatggtacaccggttaacgttgactacaatatgttcttgacagtaaatgtcaactacaagtggggtgtattgagcaaggataacctgaaagtcatcgttaagaaggctgccggtacaccgagtgccaaataattaagaagagattcttgatataatttaataaaagggacgtcctcttgcaggacgtcctttttttcaatctttcatttataaatatcagatatgaagaaaatactattcattttgaccgtgtcagtttcactcatctgcttttcttcatgtaagaagtcagcagctacacatccttttccaggcaaattcatcactgaaaccggtatccaattcaaccttcgatccgactccaccaccttgattcaatatgatgattccagctcttacgagggtacatggagagcctataatcaaggagacacactaaagtatgccactattgagtttgccggttactttaactattattatctgcgtaatggtaaactctatcgcaatgaacataatatgatacgtcaagttcttggtgaagaaattgaatatcaagattaaaacagaaaatggctattgctattcctctattctttggatgaggaaaagaatagccatttcatatgatagttaaccacacacttctattaataatcattttatgattatcatctaatgattattgtgatattttctatatatttgcgtgtaaactcaataatcatatgaaaaatccatttgttacgaacggctatgtgtcaccagaatatttctgtgacagagagaaagaaacggctaaaatcgtctcacttttgacgaatgagaataacatagccttgatttccccacgcagattaggcaaaacagacttgttgcggcattgttttggacagccggaaatcaaggagcattatcacacttttatcatcgacatctatgccacaagctctgtacgcgattttgtgaatgttttcggcaaggctgtactggatgaattacgtccaaaaggtaaatccgtatggagtaccttcctgaatgtcctggcctctcttcgctccgaaataacattcgacatgaatgggcagcctacgtggggaatcggtctgggagctataaccaatccctctgcaacattggatgagatattctcctatctgaacaatgccggaaaaccatgcctaatcgccatcgatgaattccagcaaataaccaaatatgcagacgatcccaacatagaagcggcattacggacacatatacaacgctgttccaatgcccactttgtcttctccgggtcccataggcatctgatgggggcaatgtttacttctccgacacgtccattctatcaatcagttacattgataaacctgcctcccatttctgttgataaatacgcggagttctgccttaagcactttgagcgggcaagcaaactcttagatacattggtagtaacagagttatatgaacgcttcaatggtataacttcgtatatgcagaaggttatgaacattttattttccatgaccggaactggagaaatatgtattccctcaatgatagatactgccattaacgaccttctagacttttctgccgacacctatgatgccttattatatcagatgcccgaaaaacagcgtattgtatttatggcaatagcagcagagggaaaagctaaggctatctcaagtggtggctttgtacgtaaatacaagttgcaatctgcaagttctgtctcttcagctgtaaaaggactgctagaaaaagactttattacgtatgataaaggtatttaccaggtatatgatcagttcttccaactttggttgcaaagaaacaagctttaatggtttctttcttgaatcttatattcattcaatttatttgtaattgcagggcaaaccatttataaataatttagaaatgagcagaaatgaaattaccttacaagagatgttctcctcagtcattggggacgggctttctttatgcaaaatcaccggtgcgagagcttaattcaggttaagaatatagttaaaatacctttttcttttatattccgacaaaaaagaggatatatgtaatgtccgatgattcatgtattcggagtattactaaattcaaaaataaataaagttatggcacgaaagaaaaaagtagaagaagaacaaccggtgactgccgaagttgtagagactaaaaagaaatcttcaaagaaagcaccaaagactaaaatgtctgctcaaaaagaaagcatacaggaaaccggtgttcaagagccggttgtcaaagaagaaggcacaaaagattcttttaaagacaaagattatacaatcgatgagcttatagatatgttagggccggatattgattgtgaggatgatacagagttttcattaacggaagatacttcttcacaagaacagaaatacacaatggaggatatgcttgctgtattggacgagtcaatcgataatgacgatgaagaatgtgtttcagatgaaatacttgataaattcgacaagacactcgaagaaaaagatttgggcgatgattattttcagaagaaagaagaacggcttaaagaaatggagctggagcatgaacttcacgaattcgccattgatgaaatgctgaatgaataagaatatctaattttgtaacctgcaacagtctctttatgagatgtaactttgtgatgtgccttattttttctaattttgcatggtcatggcaacatggcagacatattagaaatttaaggtacacgaaagtgtttaactgattctccggaataaagtctggtaaactattaacgaacgggaataagttagcatctctcgcgtcatatccatatatggcgtggggagactgttgcttgttttagttcaagggttttaccagagcctattccgtaaaataagttagcagccctcacgctttcgcattttataaacttcttctgtgtgggcgggaagaatggaataaatactggtaattatgaagaaatttttattaatgttaggtgcggtagctttatttactgcatgtagtgatgacggtggttccggtagtggcaatatcaattatgaagaaggttataaataccttacgaatttgaatgtgagtgacgccaagatgatttatcagaaatcatccgcaacaagagcaacaggggacgactcttattacaaacttgacttatcaggtaatgaggtaaagttatcaatcaagggagaagacggtcaagaccataatattggtattcataaagttttgaaattgagcgataaagttcttcttgtaaatcctatcgcacaagatattatcgatttgttctataaacctgaacctgatggtttaggtataagtgtagcttggggtagtacagaatacctctccattgttgatgtccaaacagaaaagatatatcgatggcccaaggaaatagatgtatatttgggtgaggggatagagttgcaaacagtattggacaatcaaggaaacatttatattgcaacgaataatcatcagatttataagcttgatgtttctaaatttacactacaaccaatgttagctgatggacaaaatttcacgaattttgatgttactggagatggattcattatatattggaataattatggcgataataaaaactataaggtaaaatgtccgggtggtagaatatatcctattactgatattccttttgttataaacaatgaactatattcatatcaagataaaaagattatcaaatgggaaatggttggtaataatgaattgaaagaaacagaaatctgtaagatagagggtgacgatgaatatcctgatattgatatttggggtattatatataattacgcccgaaatactgttctattacaaaccaattatggtcggtactatgaatttgatggaacaacatatcaatcagtagaacttccaaatagttttaattggcatgaaggagttgaggggcatttccaaacgaatagagcatggtatatacaaaataatactcgcttttataaaatgagcatggcggattatcaagagtcagagttcagaataaatgactatgaaatacaaaccctttttgcaagtccagaaagttccaatataacatttagtggtattagatatatggatggtgcaaatgttgtaggaatcatcacagagtcagatgaagtggtaatcgataatgttgccgacaacggaaataaaattattaatcttatttcgttgaactgataataatcgagagtaatacacttatagaatcctcttattgcttatgtagtaagaggattttttatacccaaaaactttaaaacatgaacgaaagaattactccatccaacattacggagctgaaagaaaatgaaatatttgtgttcggttcaaactcaaacggtgtacataatggaaatgccgcagcaacagcgatgaaattcggtgctattatgggacaggctgcgggaatacagggacagacctatgcgatgccttccaaacacattgagaatcttaaaaaacatattgatgattttctactatatgcagaacaacattcggaatatacttttttagttacagagataggatgcggaatatccaaacattcgccatttgagattgcaccgttattcaaagaagcggttcatataaagaacatcaatttgcctttgtccttttgggatgttctgaatggtggcatacaagccagaatcaaacaggttgccgaaaaagaatctccttccgtttctgatttttgtcaaagaacgggattgtcttttactatactgatgaacattttattcagaaaagaacttcctacagtctggattgtgcaaaagatactgattgcctttccgtctataaatgcaaggtggctacttttaggagaaggcaatatgaaactcacgaaacgcaatagttttttcacaagaataaacgattttctgcatatccttttcgcttccaaatagacgtaagattattattttcccataccaaaaataaggctgttttcgtctcctgtatcgtgcttttctcctgcctctaatactcggtataaagaagcacgagcatatctcgaatatgaaagaataaataaaagtagaaaaatattacatagtgaataaagtgaataaagtgaactatattttataaaaagtataaagttttatatcgttatatggtctataaaataagaatatgctctattataaaaatatagttcactttactcactttgttcacttttatcttttcttataaaaggatttctgtagggcaattctttatatcaaagttttctatggcattccataaatcttcttgatattcatataatggctctatcaggacttgtggtaaaatagccttgtctgatattggggcgagacggaaaccggaagtgtcaaacttgcgtccaatcttactttccattctataagattcaacgacctcaaaagagtactctcctaaaaacttcaatctgcaatatttttgaggataccagccgatacagattatttcattttcaagtaacgaagaaaacttgaaatagtccattccattgaatcctttctctatgtcaaagtccgtattggtctgtttgtattcgtggcagaatgtttcccaatccttatatcctaaagcacgagccatgaaagataattttccaacatccggctttctttccttgtctgcatctttatctccccaataacgacgtaatgtatcaacgctgatagtttcagattgctggataacgcttccgtcttcatattttgggagaggaaaatttgtattgctctgtttctttatataatcgcataggtcagagtatgcattatctgaactcaaatctatattagaaactcttactaactcgttttttaaagtttcaaatctctctttgtctatcggtattcttttctttgccatattactacatgatgtttatgacaaaaatacaaaacgtaaccaactaatcaaatatatttcatgcctgaacgtgccaaaatcaataatttcttttcggcaatatatgtaacaaactaataattagtctgatacaaacgtgcttgaatgtgcctgaacgtgcctttttatgccgcttttggacctttgtatttttgcaccagaaacaaaaaacaaaaggtatggaacatcaaaaaacaagttatgacacgttgccggaacggatagattatctgattcaggaaatatcagagataaaaaacattctgcctacactttgggagtttttcacctcactattccctacactttgggagttttacccttctttttttgtttcaatgtaggttttatgtatatttgcagcaaatcaatcgcttatgaaaaagaaactacctattaccaaaaacaaagatgttgttgtttcatgggtatatacatggtctaaacagcaagatatgtccatacacgaacaaagaatagtacttcgtatcttggaagcatgccaggcagaattgaaaggggtaaagctgaaagattatgcaggtacgaaacgcaaatttgagcatggactttgggatgttgatgcacaaatgcatgtctcggacgttattttttccggacgtgattacaatgaaatcatagccgcactcgattctttggcaggacgttttttcacttacgaagatgacgaggagtggtggaagtgcggatttatatctaatcccaaatataaaaaacacactggcattataacctttcgtgtgtctaatgacctttgggatgtgtttaccaagttcgccaaggggtacagagagtttgaattaaacaaggctcttgcgctgcctaccgggtattcccttaggttttacatgctaatgagtgggcaagtgtaccctttggatatatcccttgacaacttgaaagaccgccttggcataccagcggacaagtacaaggacaagaacggaaaagatagaattgacaacttcgaggaaagggttttaaaacctgcaaaggctgcgcttgatgagagttgcccatacactttcaactacgtgaaagtgcgtgaaaacccaaacaacaaacgtagcaaggtgaccggatttaggttttacccggtctatcagccacagttcagggatgaagaactggaagggaaagaattgcaggcaaaggttacagcacgatatcagatagacagccatgtatacgagtatctccgttattcctgcggtttcacatcggaagagataaaccggaacaaagagacattcataacggcacaagaaaagataaccgaccttatcggagaactggctctcctaaacggaaaatcacgagaaaagaacaatccgaaagggtggattataaacgcccttaaagggaaaatcaaggataagtaacaggattacccggctgaaacactccgggtaatcttgtcaaatcagaggaacgatttccatttctacaccaagttctttcatctgctgttgtatttcctcgctgcttagtttctctttcgccagtgcaagcccatgaaaggcgtcccagcctgccggcttcgaaacgatactaccgtttaggacggcatgggtgatttcgccgccggacttcgcacccttgttcagtatgaagaagaaccggggttcttcgtgttccgttgttcccataattcgtaaagttagagtttatttgtttcccttttgttcccttgcctgctcttggaagtattcataatactgcttgtagttgtcccggtctttggctgcatccgtccaaagatagcacatgaaacaagcgaacaatagggagataacagcacaaaggattgagtagaacgaaatccgtttgtccacataaccgccgtttttcattctgtacccctgccgttcaaagtccgacaatacgttttttaggcgattttcggcactttcgaggcttttcccgtctatttgtacctttcgggatgttgcatcctctatgcgctttgtataggcttcaatacgtcccatttcttgaaaaaacagttctatcgcaagctgcgggttaacctttggtgctgtgtcttttcttttccgggggctgtactgtccctgcttaacggtggaagctgccgcttccgggtgtgagtttgtttccatgagatatgttcattgagttatatttcagtttgctttgtgtccgctcgatatgggcgagagtgtagcctttccctatctcgctcgccttatactccgtaccgcttcgggctgtgacgtagtagccgttaagttttccggtgcttgccctggcttcccgaactttaaaacctctcctaccaagttcttccttgaatttagtcaagtcaaagccctgcatcttcttcaagacgtcgtccatggcttccttgatttccgctttgttggctttgccgatgtcctgcgactgtacaaagttccgttccttggctatggcgttggcggcttccgttgcctttttccctatccagttatcccggtacagttccccggaaagggaaacccggtttgccagtatatgcaggtgggcttgttcttttttgctctccgtaccgctgtgccggatgatgatgtactggtggttcgccagccccatgcgctgcatgaagtcgttaccaagttccgcccagtccgcatccgtaaaggtggcgctttcctctatcgaaggactgacctcgaaacgtaggcaattgttttttacgttcggaaaatcagcgtggtatggtttcatttcctgtaccatttccgcacccgtacacccgtaaagttcatgccgggctatctcgatggcagctgtctgtccgtctatctctttggcaaggtcatactccagtgcagccgtaccatgcgatatgctctttcctttccctatcatcgtgaaagtatttttttaagttcggtgattagtgcctgattctcttcaaatacctcccggtactggcgaccaccgaagtagttgttcagccgttggagcgttcctttcaactgggctatgtcccggagaagctgccgttcctcctcggtgtacctttcccttgggcgacctccaagggacaaactccggcaatactccgatgtgctcatgctacatcgggctgcctgctccgcaagtgccagcttttcataccgggtacagcggaatgtaatcttttcgttccgtcttacttccatgtcacaaaggtaatcttaaaatctttttgagcaaagcgagaaaagcaagaattgtccgacaaggacacttcttgctatatatacacatgccgcatgggaatacatccatgctaaccgcccggcaaaaagccccggcgtgttagaaaatccccccacagcctaacaatttctaccccatttctacccaaggggattacacgccgcagaagtcatccgggaacatgtcttccagttcgtccaaatcaatggcttcttcttcggacacctccacccattcaacgttttctttccctcttatcgcacatgagtacatctcggcggcggcaaggttagagaacacctcgtgcataggctcgccgttctctaaccagtaaacacaatattcgaccataacagttttatcatttatcgttgtaatgcccctctacctccaaaatatagacctctaccacttcctcgtaaatgtcatagattatccggtcatgggcggtgatgtgtcgagaccatgtaatatccccaccgccccttaacgcttcgggatgcccaagcccagtcttagggtgctctaacaattctttgtagattttcttatacttcttgaacaaattggggtttgatttcttccatttggcaatcaccttatccaccccgtcggaaaccctaattgtgtacatcatagactgtcgaaataagcgtcaatatcctcactgcttttgagggtaacacactttccggatttgatttcttcccttgccttgtcaatccttgcttgcagctccggggttatcatcaaatcttcacgaccaacttttaccaaagcgtaaatctcgtttttcctgcgaattagtacctgctcgccattgtcagctttggtgaaagacgctgcgaggttgtttcggtattctcttactgataatgcttccatatctgtttgcttttaaattcagcacaaagatagctatatttcaataaaatacaaactttttgtacacaaatgtgtacacgccataaaaagcagctcacagtcctaccgcccgttggttggttttgctttgctctttttccctattgtttttctttttccgacagtaaatcagccatttaactctataaatttcccttgtctgttataagcatcgtctgtaatatgctctatcacttcttcgcaaatacccatgaataaagggattaaagcatgagtttccctacattttgggagttttaatcctacactttgggagtttttcacctcactattccctacactttgggagttttacccaggtcaagggtatctcggaaggcgtcaaggcgaactccgacgccggcgtgtcaccgtccgtcaatgccctcgacacgggcgtcaaggcggcagccgccatcggcggccttgccgacggcctgagcgaggccgcgatgctccccgtgctgggtgccatgggtatgaagggcatggcctgcctgcccatctccaagcagctcgacccggtcatcggcgtggacatccacctcgtgacgataccaccttcccccgtcgtgcccatgcctcacccttatgtcggggttctccttcgtccgcaggacttcatcgcggcggcggtctcttcattcatccccccgcctccgacagcggaacagacgggcgacgccgacagcgcgaagctcgccgaggtgggccacaccgtgctgacgatggccgtcgggatgctgggtgccaccgtcaagataggcggcttcatcccgcgcgcggttgcatccacacccacgcggagcatcccgcacatccccatgggcgcaggctgggcggccccttcagcggcgatacccaagaacaacggccacgccttcatgggcagcctgacggtgctcgccgacggaatgcccttctcgggcggcggcgcgcacctgcacctcgactgcaacgacgtgggcataccgagcgtgcacaaggttccgggaatgttcctgcccacgggtgtcatcaacccgataccccccgccaggcagatactcaccagcccggttcccgtccctctcaaccccatggcggcactcgcccgcaagtgcacgggggcgttcgggcgtttctacaagaaaaagaccaagaagctggcggacaagctgcacagcaaggtcaacaagacgataaagagcgaatccctcaagaacatgctccacaaggccatctgtacggtcacggggcatcctgtggacgtggccagcggcacgttcttcaccgacgaggaggacttctggctcgacggcccggtgcctctgtcatgggagcgcacatggtacagccgcagcgactaccgggggcctctgggcaacgggtggcaccacgcctacgacatgggcgtcgtcgcggacacggaagaaggcaccctgacgctccgcatgagtgacggcatcccggtggccttcccactgccgacagcggaagacccctcgttcatcctctccgagcgcaaggaagcccgtctggaacaggacggctgctactgcgtgtgggacatggccgaggacctctactaccgcttcacccgcaaggagtacgattccgtgcgcctgcttgagagcgtgaccgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcccgcatccggaagatccggagaaagagattaccctcgcctcctacgagtacgacgccgacggcaacatgaccctccagcgcaacgcggcaggagatgtgatgacatacgagtatgccggaaggctcatcgtgaaggagacatggcgcaacggccttgcgtggtacttcgagtacgacggtacgggcgtgggttcgcgctgcgtacacacgtggggcgacggcggcatatacgaccataagctcacgttccgagagggagtgaccgaggtactcgacagccatggcgggctgacggtgtaccaccaccgtggcggccttgtgtggaagaaggtcgatgccaacggcggggaacacctgtggcgttacgacgacagccgccagctcctcgcacagacagacccgctcggtaacagcaccctgtacaaatatgaccgctgggggaactgtaccgacagctccgacccgtgcggcggcagcgtgtccgccgtgtaccccggcaagggggggctgcgcaaccgtcccatatccgttaccacaccggacggcggcacgtgggagttcggctatgaccgctccggcaatctggtgagccgcaccaaccccgaaggtgccgtcacgaggatgacctaccgcgacggtgcggtggcatcggtgaaagacccctacggtgtggtgacgaagctcgcctatgaccgtttccgcaacctcacggaggcatccgacagccgggggaacacctcgctgtacggctacgacctgctgggcaggtgcgtgagcgtcaccaaccccaagggtgcggtgcagaaaagggaatacgaccctgtgggccgcatggtgcacgtgctcgacttcgacggcaacgacatacgcctgtcctacgacgggatagacaacctcaccgaataccgtgacaacgtccagcacgtggagtacggctactccggcatgtggaaactgacaaggcgtcgcgaccaccggggcgtggtgaacttccgctatgaccgggaggaacgcctgcgccgtgtgacaaacgagaagctccagagctacgagttcaccctcgacgctgtgggaaacgtcaccgccgagaaaggcttcgacggggccgtccgtcattacctgcgtgacaggggcggacgtgtcatcagggagacgctgccatcggggacggaaagggaatacggctatgacgcctgctcgcgcgtgacgcgcgtctcataccccacggctggcgaccccgaccagacctacgcctacgggctgtccggcaggctggtgcaggcatcgaggggggaaagcacggtggagttcgcgtacaactccctgggacttcccatacgggagacggctgacggcaacaccatactccgcacctacgaccataccggcaggatactcacgctcgacagcacgacgggggcctcgctgcgctacacccgcaacggctacggggagcttgaggggttcacggccaccggcggcagcgacgccgacggcgcgggcgcgtgggaatcctcacaccgccacgacacgctgggcttcgaggtggagcgcatccttccgggaggcgtcgtccgctcgttcgcctacgacgacataggccgtctggtggatgcccgcacacgcaaggactcgcgcacacggcatatgcgccgctaccgctggggcgtcgccgacaggctgttgtccgtggaggacagcaggcgtggcgagacccgctactcctacaccccgacggggcagctcgacagggcggaataccccgacggcagggagcagtggagaaagagcgacccggtggggaacctgtatcccgacccggacatgaagctgcgccgctacctcagtggcggacggctggagcaggacggtgaatggcactgcgagtacgacggtgacggcaacctgacggaacgctacctcggcacgggaaagtggcttgacggcaagaaggaccgctggagataccggtggaacgccgacggctccctggcaaaggtggtgcggcccgacaagagggaggtggagttcacatacgacgcgctcggacgcaggctctccaagagcttcggcacgacagtgacgcggtggatatggaacggcaacgtgccgctgcaccagtggaagcagcgcagggaatactccgtcatggaggacaggtggaacacggacacggaacgccgcgacatgacggtatggctcttcgacgaggagtccttcgtgccaatggcaatgataaaggaaggcagatcctactcgatactgaccgaccagctcggaacgccgacggaggcatacgatgccgagggcaacgaggtgtggagccgggtgctcgacatggacgggaacgtcatcgaggaaacggggtagcgtgtcaatatcggacgctgctggtgcactccagtccacgtgtttgactcctttagttggggggcgtatagccaagtctatgcgtcagttttgcccttggggaccgctggccggcaaagcggacgcgactctggttacacttcgttggcactgtcccgtttaacgacggttaccatcttttcggcgatctcgtcagattctatgcctgcgatgatttggacgatattaccggatcgcacgactgctaggacgaacggcatgcggagtgcgtcttcgttgacgtttgcttggttgcctacttcgactcggatgcggagggagcatggttcgatgtcgacgatgttggaagagccaccgagggcatcaaccaacgcgagagccgattccatctcgctcctttcttccaaggcatagtcctgttgcgatccgcatcacatggtagccctttaaacgtatgatcgcaatcactgaacacgatcgaactagtgttttttggctgtttnnnnnnnnnnnnnnnnnnnnnnnnnnnnnnnnnngattgtgcggtggcatgcgcgaggtttcaggtgaaaatagatacatgactcgtcccattgatgttccgctgatttctactgagcctgttgcttctgtattaaggattttggctttggaggagtctggtcatgatcgttttgttgctcattcgttgcctcaggtgaggcgtgtttatggtggccaggttgtggcgcaggcgttggtggctgccgctgcgacgatgactgaggggcgtcttcctcattcgttccacacgtatttcatgcgtggtggcgacccatcaataccgtttgaacttgaggttcagcgtcttcgcgatgggcgttcgttttcttcgcgtcgggttgtgtgtcgccagggtgagaaagagattctggcgttgcaggcgttcacgtctgacgcccctgccgtggcgccgccggaagagctttcgagtgctttggagatttttcgggcgatggatcatccggttgggcgttttttggggaagacgacggcatttgatgtgcgccatgttcagcagtcgctgtatacgcaggcggatgagtcgttggccagtcgccagcagttgtggatgaagcctcgtgccgaggtgcctgctgaggcaagtcagcatgttcatcgcgctttgttggcgtatgtgattgatcaggtgatgttggagcctgcgatgcgtgcgttggggttgtcctggatgactcctggtatgtcggctgcgtcgttggatcnnnnnnnnnnnnnnnnnnnnnnnnnnnnncatgcgatgtggttccaccgcgatgtggatattaatgagtggttgctgttcgatggcgcgtgttcgaatgtaaattcgtcgcgtacgttggttcgttatcaggtgtttacgcgcaatgggacgctggttgctgaggctgaacagcagggtatgttgcgcgttcccgggaatgggcaggctggttctgggcgctggggtttcggtgtggatccgaagaccggtcagatacgtgctggtatggcgtagttggagagtgtctgatggtttgtgtgtgggtacctgacccgcataaggagatggaccagaatgattactgtggcgagacgagatccggctgataaggccaagattgatgcgattgaaaagaagctgcttgcgaaccctgaaatcgcgaagctgattgatgatctaggcacgtcgacaacggatgccaatgacctggttcggggcatgttgcaagcctcgattaccaggggtttgaatgctcagatggatgcccatttgggctatgagtctggcgacagaagcggcaaagctgctgctgggacagacaattatcgcaacgggtcgtattcaaagaccgtggattctaactacgggccggtaactgttgatgtccccagggatcgggcgggaacattcttgccgactatggttccgaaaggatcgaggcgtttgactgacgtcgatgacatgattgttagcttgtatgccggtgggatgaccattagggatatccaacaccacatggcaactgcgatgcgggttgatatctctcatgagacgatttctgcggttactgacgccgtcttggatgaggtactggtgtggcaaaaccgacagctagacgagttctaccccgtgatgttcctggatgcgttgcgcattaaagtccgcgatggcggccgggtcgtcaacaagtccgcctacatggctatcggcgtggatcttgacggaatcaagcacattttgggattgtggattgccaaagaagaaggcgcctccttttgggcgcaggtatgcgccaatctttccaaccgtggggtgaaagacgtctttattgtctgctgtgacgggctcaaaggcctaccagaggcagtggaggcaacctggccgaactctatggtgcaaacctgtatcgtgcacctgattcgcgcagcgaaccggtgggtggcctacggggatcgccggagtgtttcagcggcgttgaaaaagatttacaccgccgcagacgagtccaccgccaaggcggccttagaggaatttgaagcctctgaattgggagaaaagtatccccgttcagtcaaggtctggcaggacgcgtggggccggtttgtcccgtttctgcagttcccaccagcagccaggaaggtaatctatacgacgaactccattgagtcatttaacaatgagctgcgtaaagctactcgcaacagggtgcagttcaccaacgatgaatcagcactgaagacgctgtggctgatgatctgcaacattgaagacaaacgagccacaaagagagcgaagcaaggcaaacgagtctcagcgacagccggcagactcatggaaggggcccgagtttccggctggaaacaagccatcaaccaaatggccgtggcctaccccgaccgcttcgacaaatacctataaaccccagccccacacacaaacaacttgacacgctccgtagttgtgttggcgtaggtgcgggacggtttggagttgtggaacgcaaacaccctcagttgtcgcagatataggtagcgcggagtcaccactggtaactctgcactacttattggggatcgagtgaggctcagtcttcgtagcgatgcttgccttagagggcgagtattcctgcgcctgcaagggcgtccctgattccttgctctgcttccaaattattgtccgtggtcccgactaatattgcgttaaagtttataacaaggaaagataacccctaaacggcgttactttccaacccattactaacaaatatggattatatattttatagactatatcgaatgtatgaaaagcatggcgacccaccataccttagtgctgtcatccacttatgttatagcttgggcatatcactcattatagcctttttcgctattaaggaatggtatgacatgcaacataaatatgcgtggttcttagaggggctttatagcttatgcttcttactcgttcctttatgcctgttaatcatatattgctgtgttcgatacaggaaaaagaaaattctggaattaaaaaagaagtatcaaggttgcacaagaaacaagctaatttctaattggatgatattctgcattccgatttatatcgcaatcataggaattttaatatttcgtaaactgtttatagcttgataaatcggcagaaaaattcgattagtcttataaataataaagttagtaacaacgaaagatagcatctaacgatgctcctttctaaccattagttgcaatatgaaaagagtaattatactttatattttattcttgctttcaccttatacttttgcacaaaactataaggaaactattcaaacagagattgatgcaataaacaaaatgcctttgagaattgcataccttgttcctttagatagtttaggaaaagtaatagaggatgaatatatggaatttgatcaaatccattcatacaaaatcttagatgatggtcaaattaagaatgccaatatattgttcactatgtatttcgatagcgataacaatattaggaaagtatttaagcgatgggctgacgggggtgcattgcatagtatcgcatattatgattctaatgggcgattgatatatggggtatataatagaggagatgaaactcacggaaagttgtatgctgacgctccgggttttcatatagagcattttcctgaagagaatgaatgtaatgactgttttgaagcatacctattcttatctacgaaatgcatggaagctcagtataatataatattacagagccctccaaatgctaaaaggacgattttgacgccacaagttggaaatagtgccatactatgcagttcttacatttattctttgcctaatggagaaaaaactaccaaaggcgaagatggtatagcagtcaattttggaatgcctgttgtcataagtaatttaacaaatgactggtgcaaaataaattccatttttaatgctcctataggttatatacctattcaagacattgaaatcattaagtaaatatagtcagcaactaacaaggtcgagataacagcttaacgctgttcctcaccaaaccattagcaacaatataatcaacaaatatggaacgaataagaataacatcggattctccgggatatatcaaggtttcggacataggcaaggatttgagaaatttttcgagaataatagaaacgaaatatagtgaaatagactttgatttcttattttgttttagggcattatattccactgtaggtattaggtcgaaagtgagatatgaaaaagatgttaatatgttgggtatggatttaataatgtcactagatgaatttaatccgtacaaagagaatgtatctatgcagcggagaataatggggaaacacttcttcccatttttctctgctaacatacataaatacatatataaacttcccgttctcaaatcagtagaaaaagaattagtagaggatatgcgcttattccttgtcgaaaacttatggctaccaaacgaaaacggacaatatagactatctgtaatagaaacttcgtcttatgaacattgcataaagttgtttggcaatccgaaagagaaaaaatttgcagacaatgaacaaggtataaaagttcaagatataacttggataatagacgatgttaaaagcgaattgtctgcaacatatttgttgattgataaaaaatggcaattacaaaaatatcaggtgagaattaaagaggttgctaacaacgcaggataacggcaagccgttccctgctgaaccattatcaataacaaatggaataacaacatgagaaagcaattcattcaacaatctaatagtcagaaaagagcgaagaatttctttgacactattacttctgacgacaccttacaaattattgtagggcaagataatagcggcacatttttgttgtggcaagacgaatattatatggagttgtatttggctttatgcaatatgtccataaagctaagtaaagtcaatactataaattttctgaaatggctgaaaggaaacaagcaagacttatcattcttgattcatcccgtgttcggacaagaatgcattgctctcaatgcagtagaactgtcagaaaaaatagtttccaatatggatagtgacggagattactacgatacattaagacaaaatgacttgttatgaagatgaatacaacaaacaataagattcatgcagaattgttctgcactgacatacagaacaaaaacacagagagaatattcgagaagttatttgaaacttccattgaggaactcctttctgattatgatgaatatgatgaaatagacgaagagcctatcgagatagaagataagggcgttatgattggtttcttgcccgaaaccagcaaagagcctgcccacattgagtatattgatttggatataaagagtaatccgggcaatatggaatatctctctgtaacattgccggtttcttttgatgtacaaattgaaacggcattatcttcttacaaaaatctaagaatattctattctctttatgacacagagaagccggaagtaatagtctttcaccatgaaaatttacggtacgaactcttagtaacagaaaaactttccataagcagaataagagtatgtcgcagcgaaaatgaatcgaccgtaaacatgagaacatattatccttttggtgaagaatgtgaaatcttgccataatgaatgaatatgctttcttagagaattatattgataacgagccaagatagctgctaaacgcagctccttgtcaagccattagcattaacgtgcgacttaaaaagtaaatatgaagatagtaaataggacatttaccggccagcctaccaggttgcgccatgttcatactgcccaaggcaaggctgtccgtacggaggtccgtacatattcctatgaccatgcaggccggttattgacggtgaagcacaagctggatgctttgggagaggttacgctcgtgaacaatgtctatgacgacctggggcgtctacagtcgaagtcgctgcatggcagtgccgtcaacaagcagacctatgcttacaacatccgcaactggctgacgggggtcagcggaagcaagttcacgcagaatctgtattataacaccggaaacggagtagcgaagtacaacggcagcatcagcagcatgacttggaaggcaggcaatgaaagcaccgtccgcggctataagttcacctacgacggtctggataggatgctgaatgctatttatggggaaacggcaggcatcaatacgaatgccaaccgtttcagcgagaatgtgacgggctatgacaagaacggtaacatcaagggattgcaacgttacgggcagaccggagcttctgcctacggcctgatagacaacctgacttttacgctgaacggtaatcggttgaaccgcgtggacgatgcggtagcggtttccacttacaacggcggctttggttttaaggacggcgtgaagcaggcgaatgaatacacttacgacgctaacgggaatttaactaaagatttaaacaagggaatcaccggaatatcgtataattgtttaaatttgccgaatgcagtaaccttcagtgacggaagtacaattacctatacctatggagctgacggcacaaagctaagaacagtccataagataggcagcgctaccaccactaccgattactgcggaaatgtggtctatgaaaacggagtgcagaagatgcttcttaccgaagagggctatgtcaacctgaccggaactcagcagtatcactactatctgaaagaccatcaggggaacaaccgggtagttgtcaaccagtcaggcactgtagaggaaacgaaccattactatcccttcggaggggtatttgcaagtactacgaatgtccagccttataagtataacggcaagaaatatgacacgaagaaaggactgaattggtatgactatggagcaaggcattatgatgcggtactgggacggtttacgactgttgaccctctggcggagaagtattattcgatagggatgtatgcatattgtagtaataattccgtacgctatattgatccgacaggtatgtccataagtccgatttatgacgaagaaggtaagttgattggtacagatgatgaaggtctgcaaggagaggccattattatgaacaagtcaaactttaaacaagacatgtctcatgaagaggcactaagccatagtttagggtataatggattggcagatgaagaagcgcgctctaactacttggagagttatacaagtcttaaagacagaccggattatgatggatatttgaccttggaggaagctaataaatggtatagggaagggaaaggacaacctctattcacatctttagcaaaaatagatttatcagggatatactctttaggagaaaaatatgtgagagaaataaaaagttttaatttattgttgcatagtggctccttaaatgatggattagtatacggaaacgttactttaaaacgatatccgaatcattcagtaagagctttttctgataaatatgattttgaaatgcacaatggtcggaatccattgaattggggaagaaatatagaaactattataggaaatagggttgcaggaaggggacaaccatatgaaataaatatttatggaagtgctaaactgacaccatttttaccttggataaaataatatgaagagatatgaaaaagggatgtattgttctacatttgctttgtagtttatttattcaaagttgcatttctgattctattaagaacttaggaaatggatatttttatagagatgaaggagagaatataaaagatattctttgtcaaaattccaatggtggagaaataccggcaactgtacttgactatatctataacgatgaatatattattgcaaaacagaagcctaaatatcctcaagaacctttatacaaaagaaaatatgaatatggaacaaacgatagtttattctattggataattttaaaaacaaacgatgttgtattgggacctttgagttggcaagagtatttggatatgagattaaaataccaaataccaattgagctatctttgtactgattttttgtcgcagcggatgttcttcatccgctgcttctgaatattagaatctcctgcttcgataagccaaatgattccctgcttatattgccccatctctataagcagggaattttatttcatacctgacgaacgttccgggcggagctttattgaaccgcatagcctataaagtgaacgggacaggtaggaacgccacgctttccaaatcagggaactgctcttcgggcaatctttacattgtgcgcaccacggacgaggacaggaacgtttcctgcctattcaccgacaagctgggacgtatggtattgcagcgccgggtcatcggaagcgacaaccacgacacctactatgtctacgacaaccgggacaatctccgtttcgtccttccctcgcgcctgcgggacgagggaatctcacaggaaaggatgcactggcctattgctatcagtacgacagccgcgaccgctgcgtgtggaggaagctgcccggatgtgatgccgtgcgctatgtctacgacaaggccgaccgtctgattttcgtgcaggttatcggctgaaaaacagccgataaaattgtcgtggcggaaaatagaatggttacaattcttatatagtagtttttttgcttattacagaaatgaatcagtattaaaatttgtataggattgtttttataggaacttttatagagctatcagtaatatagaaattataagtgaatattgtttgcaattattgggacggtaatttttgaagataattatcttgtttatttatagaagaagattttttaaaagtagtttttatatgataccactagtgttccgttaaattttcgttcatgtcatttttgagaaaattaaaatcgtaactatttgatatttagggaataataatttctatagactgagtattattgtaatcttcatttcaaatccatctgctttatatgtgactttaatttattgaatatcaataatataagaaatgtgagactgattttaacggaatactagtgatctgatacattaaaattggatactaaaatatgatatcttatgcttgttactatcgctattcctgtttataatggagaaagttatctgagagatgcaatacaatctgtagtaaatcaaacttttcaagactgggagttatatctcataaacgatgggagtactgataactctttagctattatgcaagagtatgctttgaatgatattcgaattaaagtgatagatgatggacaaaacaagggcttggttactcgattgaatcaatcaatagagacggctataggtaagtattatgctcgaatggatgcagatgatatcatgtatgttactcgtattgaagaacaagtaaggtttttggaatctcatcctgatgtagatgtattaggtacttctattatgataattgataatgagaataatattgtggggtctaatatgcatgatggaaaggttaatgcttttattcatcctacagtgatggggaagtcggagtggtttagggctaacccctattgtggttgggcattaagggctgaagatatggaattatggagtagaacagcttctaaaagtaatttttgggccttagataagcctcttttattctatagggagtttggtgtgcctgtaacaaagaaatatattcaaacgcaaaaaactttacttagaatctttttgcgttatgaaaaatatgagaaatcttgcttttggtggttgaaaaatagtttgtatgctgtagtaaagattgttgcttatataatatttgacctgtttgataagacagatatactggttagtaaaagacatagaatgccattaccgggaacaaaattgttatctaaagaagatttgataaaatctattagtcgtaaatagtttagtagatgatgcaaagatattgcctaatgtttcaatagtaataatgctaaagtaggtgctaattgtgtggcggtggaggatgtgccagatggggcaacggtggtattgccaaaacaagaatcataataaagagaactgaatgaggaaaaagtttattgttgtaacgacaattcctgcctctcttcgattttttgaagggcaattgaactttctgaataaaactttcgaggtgatggctatatcttcagataaaaaaaacttagaagaagttgggcagaaagaggggatttctgttcattgtattccaatgcaaagacctatatctttgtgtaaagatataattagcttttatcgttttattgtgttttttctgaagtctaatccttacatagtacatggaaatacccccaaaggcggtttcttatcaatgctttcagcaaaaattacgaatgttcctgtacgtatttatatatgtcatggacttcgttatcagggatatggtggactaatgaaaaaattgcttcaaatgatggagaggatttcgtgcgtgtgcgcgaccgaagtgatatgtgtttctgttggagtgaaacagacattgttggcagaccatatatgtaagaagcaaaaactgaaagttatagcttatggtagtgcaaatggtattaatctaaatagatttgataaacaaaaaataggtacaatagttcttcctcaaatctcgaaaggtggttttgtgttttgttttgttgggcgtattgttaaggataaaggggtgaatgaactgattactgcttttgaccgattatcgactgagaatgaagatgtacatttggttgtggtaggctcgatagagaatgaacaaaatccgatagcagaaattactaaaaacacgatgcaagtgaatactcgtattcataccgttggttttcaaccagatgtaagaccatatatgaaccaatcagatgtatttgttttgccgtcttatcgtgagggctttggcatggtgcttatggaggcaggagcattaggaattccgtgtataactactgacataataggttgtaatgaaataatccaagatggcgttaatggcaaaataattcctccttgtgatgaagaggctttataccatgcgatgaagtggttctatgaacatcgtgatgatgaagtgaaagaaatggcaaagcgcgctcgccctatgattgtagaacgttacgaacagcgtaaggtttgggaagcgctattggaagagtaccgttctttgggaaagtaagatttagtattgcataatatagaagataattttgggtaatgtttacagagtaacattataaatacatctaggtaataaaccgattttagagttagctcgataattatgtaaccattctattttccgccttgacataagttgttagccgacatatctttgcgcgtaaccattctattttccgccacgacaattttatcggctgtttttcagccgataaaataaaaatgtccgtaagaaaatatttttgttttaacattccgattgataaaaacatggcagaagggcttttttgtcgcagtccttaccatgaagaatacattcaaacaagtgcttcaggtaatcctgaggatctatgtcattaagtttacagctttctatcagagagaagatgaatgccgagtttcctgctgcatcctcactgccgatgttcatacagttcttgagcagcagctttacaggtttcatcctttgctcacagaggttgttcgatatttccgctgcaccgtccttgaggatatttttcaaggatttccactggtttatcgtatagttcacagcctttctcatcagttcgtttgccatgagtttggtatcctgcatcatcatgaccaccttatgatggatacgttcaagaataggtctcgtaagcttaagtcttttttccttaatctgctcaccgctgagtttcattgtgcggaacaagtcttcatttctgaacatatcaccgatagggtctattatatccatcgcagttctgtctgatggcaaggcatcgacccacaacctcctgcagtgtgtccagcatcctatatgaagcacctttgagtcttctccgtcgaacatcctgtaaaccgtatatccgtctgtagatacagatcccataaaatgttcaaggaaggtctttgctacatcagaggctctgctgccgttattgtaatgatagtaaaccaacttgacatgctttgcaaaaaaagcccataaatactttctcctgtaagccttgccttccggtgtttcaactccgacaagttcggtcgtctcgtcaaccataaggtattttgcctgttgtacaaactccttgaagacatcttccataaactccctaagtctggagattccgttatggatatagctgttcagcgtggtgttgcttatgtggatgccttctcttgcaagcagtcttatctgtctgttttcaggcatactgaagtcatatttcagacaaagcagacgggcaagcaaatcaggggaaaagattcctccaaggtttttcaagggatgctccatcgtgttagtgaaagtgccgtctgcaagctttacccttgccaccttgtacacatgctccacgttatgagcacgcacatgttctataaacctgtattcccacacatcagccattccgttacgcttcataagccttgcaccatccgggagttggtaatagtcttctatttcatgaacaattaccttatccaccttcagcctggtctttgctgcacggggagcagtttcctttttccttgaaggcctgcagttctgtgcaggtacgttaccggaagaggtattgctgccggtaccgttaccatcggtcttattatcatcatcacctttcttgccagaaccgtcgtactcggacttctccattgcagacttgtcaatgttacggttgttcagcagccttctttgttctgaggtacggccgaaacggtgtttcctgctgccctcaagctgaagcctgagattggatatctcatttgccagcatcatgttcacctcgtcttttgcctcaagctgctttctcataagttccatctctttcctgtaatgttcaaccatactcgattgcttttcgagggattctttgaggtcattgattgtatcaaccagagccttggagttctctttgttggattcctcaatagccttaagcctcgcaatcagttcgtttacctgtttgcgaagtcctgccttttcctcattagccagacccagctggcagcaaagtaactcgtatgccctttcatcaatcatgatataaaggtacgaaaaatcaggcagttacgcaaactttttatcgtttatttttgtatcattttgttgataatcaatgtattaatattaatctttcggactaacgtacatcttgtcaactactatactttcagtaagataggccatgtccgaccattgtatccggtagcatttggagacttcatcaaacacaggtttcttgaatctccccatgacaggacgtttctcgtaaagcacataaaatccgcgttcataatgaagtattttcacaacttttcggttcctggacataaacatatatacattggatgcatcgctcgggtcaagtgacatctctttccttatactctcacacaggcggaagattcctttccgcaaatcaacattaccgttaaacaggtaatagttcaggttagcactcagtccaagcatatcatcctatcattttattaagcaacaggctcaagtcaagaactgtggtgtttctcaggaacagtgtggcacctgatgtcaattgcagcttaacccatcttataggaggttcaccttcaggctgtttaacttccatcttcacggttggattgttgcaaggcttgccggttatccggactttggcaaccttgggctgctcaacctgaactgtcttgcctaacttctcgctccacagctggtgacgctgccagttcatgaacttgtcgtaatttactccataatcagcacagaactcacgaagatccttggtctcgctgcataactggtagaggtcatatacctcctggtagtttactttctcttttgccataatcatttttgttaaaggttacggcgcaaagatatgtcggctaacaacttatgtcaaggcggaaaatagaatggttacaccagagttttcgcggaacttggtacgtttggtaatgtaaaatcaccatctacaccggtaatagcaccaacttgtgtaccttttaccaatacagaggctccaataactggctgcccgtcttcttcagaaattacaacacctgtaaccttctgggtttgggcagttactaggcctattccaacaaaaagacaggccaataacagcattaattttcttttcataaattctctcttaaagtttaactttacattaattgtttctttactctaacaaagtgcaaatatattaataaaactgaaacgaacaactattttattgaaaaaaccttgtaaatctatcaatctgttaattaaatacgctactttatgcttaataacagatttttcatacttaaaaaacctaaaccggcttatgtttactatcactatgattccctctttcaaggtgatttttccaagaaatacacatattttaaaacaaaatggttaataaacaagccgctaaaacaaaaaacatacctgattttgaaacaaaatgagaatttccggagattaaataccaattaatagctaaacacaaaaagacactttttagagatattaattcttattctattctcaccgagcacagaatatcgtcttatttgttattagtattaattaaaaccaaacaaaatgagtaaaattatttacaatctagtgtacaacagaaaaagaagcctgaataaaaaaggaatggcgttagtgcaagtagaagcctatttggatagaaaaaaaaagtatttctccaccaaagtttatctaaagccagaacaatgggacaataaaaagcttatcgtgaagaatcatcctaatgcggatgcactgaatagattgatatatgaatttatggctatgatagaaaaaaaagagttggaattgtggcagcaaggaaggcgtatttcattagaattactaaaggacgttttgagcacaagcgaaaacaaaacctcttttatttctttttgtagacaagagatagcaaactctgctctgaaagaaagtacaaaacgaaatcacctctccactctttcattattacaacagttcaaaaaggatgtaaccttttctgatttaacattcgaattcatatcctcctttgaatatttcttgcaatcaagaggctatcacacaaatacgatagccaaacatatgaagcatctgaagcggcatataaatgttgccatcaacaaggattatatagagatacaaaaatacgcttttcgaaagtacaagattaaaactatagaaaacaagcatacgcacttatcccctgaagagctggagaagttggagaaattaagcttggctggcagatatactaaattgcagaagactttagatgcattcttgttttgttgctatgcaggaatgagatattctgattttatcagtttatcacccgataacatcgtggagatccgtcaagaaacctggctaatttataaatccataaagacgagtacagaagtcagattgcctctttatctcttattcgaaggaaaagggcttgttattctggacaaatatcgggatgacttacaaagcttctttcatttaagggataactctaatgtgaacaaaaatttaattgtgatttcccgcctagccggtttatcaaaaaagatttcatttcacaccgctcgccatactaatgcaactctattgatttataatggagtaaacattacaacggtgcaaaaattgttggggcataaaagtgttaaaaccacacaagtgtatacgaatgtaatggatatgactatagtacatgatttagaaaagagccatgcactcatgcctttgcctaaaaaaacacgaacttagcatagtcaatactgcactttcatatcattagtcatatacttctcctttaaagtctattcactcactattctgtttcaacctgctcgctgcaaactcactgcatacgttttgcagtattactgcatattgtttgcagtaccactgcatattgcttgcagtaccactgcaacagctttgcagtatcactgcaataggtttgcaaaatcttgcagcaagaaactatttataatcaattagatacagcatagtgtgaatagaagattaacattggtgttttatcaatatttaaactgattggaggtgtggaagctaaatttgcttccacacttttgcattgcttccacagcatctgtgatgccgatgaatagagggatataaggaacgggtggaagcgtggaagcaaaaatgatgaaaactgttatgaggaaacaattgttgtcttgattgtttagccaatcagaaagttttgaatttgctgttttctgaagctattgaaatattcttttacatagactttagtagtttcgctaataaagtgacaatgtagaataaatacttcattgaaagcagctaagatgatagatattgacaaaagacatgcttcatataagaggaagaatcatttaaaatctttaagcagtgtattaactttatggtatacatctgataacttggttgttaatccaacaaatagtatcacagcagtaaggttttatgcgttgccccccatacacataccttgtaagaaagaaaatttcgctatagttatttctatcacacagtataattacctgattattagcgaaataaataacaatatagttccgcgaaaactctggtgccggaacggatagattatctgattcaggaaatatcagagataaaaaacattctggtaaacagaatagaaaaaagggaagaaacccccaaatatttaagtacggaaaatgcactggcctatttaaaaaagacaggttttccaatgagcaagtcccaattgtataaacttacatcttgtggaagaatgcctttccataaaagtggtaatacattattgttcattccagaagaacttgacaaatggtgtgaagataaaattcaaactgtatcacatgaagaaaatgagttgcaattattaattaaaagtcctttaaacaaatggaagaaaaaagtatgatgaaaaagttattaacgcaaagaatcaagaagccggaagagatacccaaatatctatccattaaacaagccaaactttacttggagaaaaaaggatttttggtgagcgagtcggaactatataagatgacttcggaaagcaagatacttttttatcagtcaggaaaccggaattacttctttcctgacgaacaggaagaatggctgcaagaacaactcggaatgaaaagtgaaacgagtcgatacttaacaggacgagatacaattaattatattacaaaatcggctcaattaaaaaaagaaaaaatgacaacaatcaaagaattaaaacaatttattaaattctggatacatcaaaaatgtttgatattcaaaggacaaagctttaagtatgaacctttctggaatgaatataaagaatattgctcgaaacacaattatccaatacctgacgaactgttgttttgggctatacttgatgattgtggactccaaatcgatgtagatgaaaaaagagaaatgatagttatattgtctcgctaataaaattttaaacattaatcaatggaacggagattttaataaaatttccgttcctctaaaaaaaataaatcatgtgtgaattcaaaaaaacaaaagaaaaccctccaatagctcttaagaatgctgtgttgaaaaatagcgcatacacaacatgggatgaagcaaaaaaagaatgggagtttgataaatactattataatacaactcaaagagtatgttgcccatgcagtctccgagaaataaagcatattgttgctataaaaaataagataacgaataatgttttagaaatagatattaaatgtgcggaaatttattttggattcagagaaggaaaaaaaattaaggaatcaatacaaagattatgtagaaatatcgatttaggaatggacagagttgcacttgattatctgtttaaaaacaggtgtattggaaatattagttataatgattatgagatagcaaaaatgagacgtgagtcaaagcactattattcagaccgcataattaatgcacgtcaggagataaatcatatattaatgaattatacaaattatgagcataaagaaaaattaaagcagattgattatatgattggagtttctgaagaatatcctctattaaatgtagattcattaattacagcccgccaaacatttctaatcaatggcgtagtgaacatggaagaattacatgaatttatgaaaatcacaggtaaatatggagcatattattcggaaaaacaaaaagttagaatactggatgaatattttaatcgcaggtggcataatgctttgagtagattcgtggacgaacgagaatattgggacaaaattacatattttaccactcttacaactaaagaagaagcaaaagaaagggtaatgagtaagaaacgaacaagaaaaccaaaaaagtctaaagttgaaaatgaaattcaaaacatcaatcttgcggaaggattggaggatactgtaatagatttaaattcagatgattgtattgactattacggtgatgattgggatgaggaaaattttgatgaaagtaagtttgcgtttggtacggaatctatgtatcgaaagtttatgaatatattatatgagtggataatagaagatatgaagaaaaaggagataagaaaatctaagttatccacaaatcagtcgtattcattagaagatgttgtttgcttcatcgatattcctattattacgaaaatatttaaggaggtatcttgttcttctttctatcagctaatggttgaggaaggtttatctcttaaatattcatgccagattcttgattggctgatacgtaattctgataaaggtgtaaaaaaatcaaagatggtaacaatgaaaaatatgctaaggcgctatggattcaaacttatgcacaatgataaaataactcgtattttaccatcaaatgatgaagagcaaatatttttaacattctaaacggtttatttttagatacaaagattcaagatgtactttaaatactcttgaatctttgtctttatatatttttagaagcagattatcaaattgcttaatggtgagatactctttcatgaggtataactttataacttgaatgtacttaattggcttgagaatgctcttgacatcgatatggaggatgacggcaggctgctcgggaaatactacgattatggtacctatacctccaccggagcgatagacaaccggcattccggattgcgtggaaaactccgtttgacaaagtacatggaggacgaagaagcggacagatacagggagcgttaccctgaactggagatcgtgcaaccggcctacagcatcatcgagtcggacgagagcgtaccggacgatgccaatatctccaacccggacaacgagaccggctataagtatggaaatgcttacgtcatgaatgcccacgtggcggcgatcctcaagaagcgccaccgtgtgcttgccaaggtaacgaaaaagcccacgagccgtaaagtggagatggccggccagacagttgacgtgaacaatccggacggtgagatgacctattgtcctttggatgacaccaacagcaataaatattacgacggaagcgcagccaaacttgacagcagcgagggcgactggatgatgtacgagccgttcttctggtcgaaaggtgtcaatgattacctgaatgagaaatattacagttgttacagttccaacggccccgacgatatgcctcccatccccgaagcaaccgttttgacactggatgccatcaaggaaacgcagggcggctggctgggtgaacgcaagattatgagcggaaagcccacgctgaaggaatcctataccacggacaaggcttattccgtgtgcaaagtggacgtgtcgggctacaagcgtgtccgcttcccgagtgttcccggcacagggcttatcggcagtgtgtttgtggatgatgcaggaaacattctgaagaacatcgtggtgccgaccatcggcttgaaatttgaagccggcatgtatctgatagtagacgttccggaacgtgcgaccgccctgcatttctccattctgaacacggctgagtttgactgcgtggtactgagccacagcgacaagatagaggacatggaaccggattgggtggccaacgaggagcatctgtgtgccgttgtgggcagttcggtggtgggcagtaagctgcgtgcctgcataaccggaaacactacagccggcagtatgacgtggacagacttccactattacagccagcagcggggcatgcagcagatagatgcgctgatgcacagccgcatcgcgaatctgagctatgcccggtacgggcgcagggacatgcaggaacagtgcggtgccggacagcataactacaatagaataacgggcggaacggcagaaaaaggcatgacagacaccatcggctatgatgaagcgtatgccatcaacaacaaaatcacgaattcgttgattgacggtctggttcaccagtatgcctggtataagagccgggacgaatacgggcaggtgactgtggtgcaggtgaacaatatctgctgcctgggctatgaggacatctacggcaacaagtatgacatgatggacggcgtggacctgccgaacgacagcggcaacgtgggcaaatggcgcatctggatgccggacggcacggtgcggtgggtacagggtaaaacggccagtgaccaatggacaacaggcgtggcacatggcaagtatatggatttggttccggtgggtaatctgaacggatcgtcttctacctactattccgataagtactggataagcaccgctatagtccgtgtggtctatcgtggcagcaacaacgcgggcccgtatggcggtgtttcggtgtcgggtgcgtgctacgattcctcgagtgcgagcacgagcatcggttctcgtctggccttccgcggcaaactcgttcgggcggaaagcgtggaagcgtataaagcgattcgcgaagtgttgtaagcgcaaagcgccaaagcgtggagcgaagcgactaaaacgaaagaacggtgttcggatggtttccgaacaccgttcgtgttattataaataccggcgtaagccggtcgaaaatgttttaagaaaatgaaatttgatagtgctttagtatgtgtgagagagtgcacaacacaccaatttatactatacaaatgtagcgatttttggcgagattaccaaatttcttagtaataattagaagtgagaaattaagcggaaaagggcagggtagagggggtaggggtgcgaaaaaaagaacgtttcgttttgggaaaaagaacgtttcgttcccaaaagtcgaaacatttcgttttgcggattataaggtgtcagcacctatacgtcagctttcgctttagcaggcacctgtgtttatggtaaacagtcgcttgggcctcttctctgcgaccactctatgctccatccgcatgggacttcacaacagtggctacccttatcccgaagttacgggtacattttgccgagttccttaacgagggttctcccgcgcaccttaggattctctccccgcatacctgtgtcggtttacggtacgggcggtagctctctcactagaagcttttctcgacagtgtggggtcaacaacttcgctcgcatctctgctcactccgcatcacgcctcaggctttcagtgcacggatttgcctatgcaccaccctacacgcttacacatgctcttccattcgcatgcttgcctgcccttctgtgtcactccattgctcaaacaattactaccggtactggaatatcaaccagttgtccatctcctacgctctctgcctcggattaggtcccgacttaccctgagacgacgatcgttgctcaggaatccttatgctttcggtggaaaggattctcacctttcttttcgctactcataccaacattctcacttcccacaagtccaccgaaccttccagttcgacttctaccctatgggaacgctcccctaccccgtatactttacgtatacagccacagcttcggtttcgtactttagccccgggaatcttcggcgcagggtctctcgaccagtgagctattacgcactctttaaatggtggctgcttctgagccaacatcctggttgtttatgaaaccccacatccttttccacttagtacgacattggggaccttagctggtggtctgggctgtttcccttttgaccacggatcttatcactcgtagtctgactccaaggctctacagtatatccattcggagtttgacagggttcggtaacctttacggcccctagcccgatcagtgctctaccgcctatacttactacctcaggctagccctaaagctatttcggggagaaccagctatctccgcgttcgattggaatttcacccctacccacatctcatccgaaagcttttcaacgctcaccggttcggtcctccacgcaattttacctgcgcttcaacctggacatgggtagatcactgcggtttcgggtctacctacactaactagcgccctcttaagactcgctttcgctgcggctccgtgtcttccacttaacctcgctagtgcagataactcgttggttcattcttcaataggcacgccgtcgctttcgcttcgactgcttgtagacatacggtttcaggtactatttcactcccctcccggggttcttttcacctttccctcacggtactatgcgctatcggtcgccaagtagtttttagccttggagggtggtcccccctgcttcccacaaaattcctcgtgcttcgtggtactctggatctcggcctctctgctctgcctttcgtctacggggcttttaccctctctcgcttacctttccaggtaattcaactaggcctgacttcgattctgccggtcctcaaccccgaaaagccggagcttctcggtttgggctctgccctcttcgctcgccgctactgtgggcatctcgtttgatttctcttcctccgggtacttagatgtttcagttccccaggttccctcccttgcgggtgaccatccatgacgatggccgggtttccccattcggatatccacggatcaatacttgcttgcagttccccgtggcttttcgcagcttaccgcgtccttcttcggctcttggcgcctaggcatccaccgtatgcccttagtagcttgacttttcagctgctaagaaacttacgttcctagacttttctcgttaactctcatcaaatatagcattttgattagaggtttgtgtctattactactcactcatcattttcataataaactgtttgtctcttctatatggttttcaaggttcaaaaaagaaggctaagccttcaaaactaaacattaaccaacgaatgtgcgtcgacttgaagtctacgagatatcttactatctcatgtctccatagaaaggaggtgatccagccgcaccttccgatacggctaccttgttacgacttcaccccaatcatcggccccaccttagacggctggctcctaataggttacctcaccggcttcgggtgttaccaactttcgtggtgtgacgggcggtgtgttatttcaaatgaattttgtatgtcagccctcccgtgaaatatttcatcctctgcatttcgacctgcacatgcagatgcttgaacagcagataagtggctcccaaagcaaagtccttggagtcgtactccgctatcaccctcaactgcggatggaaggagggattgtaggtgacacccagtgcaaagccattcagtttgtactccttgcggttgttgtaaaggtaggaaagatggacaccgatctcctccttacccacaacgggtatatgcttggaggcggcaatatagaaacggctgtaatagccgttaccttccgtggtgcctacctggccgccaccggaggaagtgaacgggtcggacgtccccagcacgacagccggcatgtatttccagaactgcccctccttcaacacacgtagacgggcggaaaagtagcggtcctggttcgtgaacccgctatacccgtatggcttcaatcccaacgcctccgccttgaagagcgtacacgtgtaggccacttccagaaaggggaagatggtgacgttcaggaaatagttgtaggtatgatagtaccaggtgggcggtgtgagctccttgttcaggaagttgccgccgaccatgaaagtcttgtcgcgctgcatctccgcagagggcgcatgcaacagcccggttgtaccatacgtcaactgggaaaaggccgaaagggaaaggctgcaaaacagaacgataaagaatagcttaaacttcatcatcacatataaattcagtcgctgataaaaaatgggttgctttataacgtgcatcggacatagtaccaaaaaaaggcgtctgagtcccagacgccttcatttttagagtctatttgtcacttggagtgtattattccaggataactacgcggttcaggaagttcttgccgaacatgttttcagtaccaccgaatcctacgagttcaagctggtccttgtcaacaccctgagcaatcaaagcgtcgtaaacaacctgggcacgcttttcggacagcttctggttccaagaagcgctaccggtagccttgtctgcataacctgcaactttgtacttcttgtccggattagccttcagaatcttggcagccagttcgatgttaaccttgccatagtcgtccagacgggcgctgccaatcttgaagaagatggcacgcggaccggcaacttcaacttccttggtcacttccttaacttcaggtttagcgttggccagtgcattcttgcagttagccaggtcagcctgagcctgagccagttcacttctatatctgttgatttccgcattgactgcgtcttcgtcaatcttagaaaccggaataaacttcttaccgccgaagatgtagctaacacctgcggtcagcatacctgtaccttcagccttgcgatggctgctgatattaccgaaaatggacggagcgatggcaccgcgagcttctacgtcaatggcccacttggtgttgatattgaacttcaagcccaaaccggcagaagcgccgatacgtgcacgcatttctgcttcaccggcaggagccatagactgcgaagtaccatcagcactaattgtaacatccacattttgagattttgctacagaaatttgaggtcccaagaaaccgtaaacttcgaagaaacggttaggattagcaccggcaaacaatgtagaaagattgatcattgcatcaatgttaccacctacataagtcttgttgtgttcccagtatgcatcatccaaacacaaatgctgagtaataccgtttacctgagcacgtaccccccaagtcggagtaatcagcttaccaactgacacgctgaaatgcggagcaatcttattgaaaccgtcattgttgatggcgtggataccaccacctacactgacaaaaatattatcgctccatttcggagtgtagtagttcgttttttcctgtgcattcagatttgctgcacaagcgcctgccaatagtaaggaggctatcattaatttacttttcattttctcttgagtttaagcaagacacaataaaaattgtatctttcaagctatgagataattaacagagaaacaaaacagacttgttaacggtttagaaaccagcgaacttctataatctgcctcattttgcatcaagcgaaagaacgtccttactttttgcaaaggtacaaaacagtccccgtctttgcaaaatttcccgcaattttatttcgcccgcaaattttatcctccatcatttttcctgttctgaaaacggcttccggcttgatgtgcgcaagcccatttcagaagcagcacaagcaaagaaaagcccacgacgaccacaatgtcaccagtgacactgccatcgtcgcggacacttcttttatgtgcttgtgctgaacggccaagaccgtcttattcgtttttcttttttcgtttccgttgtcagccggaaatgccgccggatgcaggacacggcaagcgtgaatctgctcctgcgactattcccggctgtcatgtgtggcctgtcttccaaccgtcttgccctgccgttgccaatcggagcaatggcaggcaagaccattttcagacagatgccgccggaggaacacccgcgaccgcaagccatgcccgcatgacaatgacggtcacgggacttccgtcacggcggcaggaaagcgaggctttcccttgtcagttgcgccgccctttcgattttcctgtggcgcgttgcgccatttcacatacttcccccttttcctttccgtctctccaagtgtatgccaatgtccccatgccgccattccagacggcatcagtggtcattttcgttgcaggggcaaaggtaaagacgggattaggaacacaaattttttagccacaatctccacacttcgcaggctcaggtagtattctgtcgaaaaaatttgctgaacctactcccctgacctttgctttttcccctgaaacgaaaacgaccggtgcgcggtcggaagacgtcacaaggagacatcggacatacggagaggcgaaaagaaaaaggactcgacccgacctccccatccgagcaagacaagtaacaacaatctaaaaattggaagatatgagaatgacattgaacgacatcggaaaggctatgcggagcgtattgtccgcaatggtgagagcagcatggggcattaccctttgcgcaggaggtttggcggtgggcatcgcaggggaaatcctgctgggtatgttgaacttcatgttcggcatcctcaccgccctgctttcagtagtggcagctatcggaattttcatttggttattaaccctttaattcatacggatatggcgaaaagacacagcaagacagtggcacaacaatgcaggtattacgaggtggacaacatcttcgagtatatggtagaggtgtgcatcaacggtaacttttcctcattcaggaggttgtaccacgagttgaacaaggaggcaagaaaggacttcatcgcctttctcatcttggaatgcccgccccaataccacatagagattttacagaaaaccgtataaccatcttaaattacagacaatggaaacttttgacttttatatggattgcaaggtaacttgctgggaacgtacccgcttctccatcaaagcgaacagctatgaagaagccaaatccatcattctttcatgggaagataaagacgtgaacagccatatcggtatggacgagaacgtcatctattgcgactacgaattgaaccccgaaacggtggaaggactgtcccctgcggaaaacgacaacaaccctacgatggaaatctacggacgggatgacgagttgttttatcacaatatgttggacgaacaatagagcaaagttatgagaacggaaacgaggaaatacgaagtttacaaggtggacgagctttcggacaaggcgaaagagaacgcctattggaagtggttgaaaggctttgaatatgacgcatccgacaacagggcaacgttgaaagcctttgaggagattttcaaggtaaaggtaagtttaattatatagtttttctgtttcatattctttgtctttttacagctaatggttagaaaggagcatcgtcagatgctatcttttgttattactgacttatttatatttctcaatccgatgaataattattgatacttcataacttgcttgattttattaaaactgataaagaaagagcattaaaagaagaccgacaataagtataatatacctgatacttaataccgccttatctgaatatttggcattataaatattgtcttgaaatttctcaaataatacaagagtccttttcttattataatatatgtatacaccaatccaaggaagtataaagccgattatccatataataagtgttgttagtttagacatgtacgaaaaaaagaaatgtcctgtcaagaaaaatgaaaacaaaaaagatgcgaacatataagttattgaaataacttccgataagatgcaggctgcaccaaaacgtggaaattcctcattttttaagcaaaccaaataatatctataaaataaatagtcaataatctttttcataagcgactgttacaaaacatcaattatataattgtcagtaatggcttggcggggaacggcgttagtccgttatcccggcttgttaccaatattttttaagtattagccaaagatttctattcctaattattaagagcaatctctttaccaacaaatatggcatcaccacatttcataaagaaaccattttgaccattgtatttcctaagagcatagggatatgcaacaattcctttttgtggctttatgctaatttcacaacatccatgtgatgtttggtagagcaaaaaaactttttccccatgcctttttaaaatgtcatataccttattcttccattctttttcatccttatcttcaatgttatatgaatcagcaatacgaccatttcttaaaaaatgggaatcattaacatccggcttagagcgtaagaactgcatttgttcccttgcaatactaccaaaatggtaatattcgccatattttttgtatctcgtttttaattcttccattgtcatcaaatcaaaatttacgatagagaagaaaggacttgatgaatttacaacagacgtatatagtcttttgctaatgtcagcttccgaagaaggagaaatatctaaaaagaatatattaggattgtaccctcgtaattcctcacaaaattgctgctcatcattttgagtcataaataactgaaaatctctacttttctccattgtatttaattttgatgatgataaaatctttggcttaccttatcgcactgttattggtaatgggttggcgtggaacgctgtttaagcgttatcgcgcttcgttatctatattttcaaccgaatcagaatggaattttagaagcataagccgcataatattttccttatcttcccaatattcctcgtctatttcattcaacttagagatttcgttctctgttaaatgcttgggaatatcccatagctcttgtaattggctatcattttctaatctttgaatgatgctgtatgcctgcataagaagttgttttgtatctgttgcgttacttgcttccagtcctttgattgcaagcaagtaagcatcatatccccaattacagaagaattgaagaaatccaccattatacatttcaagttccagccaatataatgcggcgaatatactgtccgtttcccccatatcttgataattggaacgaacttctgcaaacttacgcccaagaggggaaaaggattgctcccaatattgttctaaattttccattcttattgcttttgttatagataatgggttggaaagtaacgccgtttaggggttatctttccttgttataaactttagaggttgtgtcaaaacgttggcacaacctcttttatattttaagttctgctatattttcttttggctatgctactttttcctcatgcatttggcagcaagttgctatattccaattatatcgggttataaatagtcccataaacaaatatttggcaactgtaatgagcccctttccttcttttatcagtttagcgcacatttttttgatattaaaggctatagcaaagaaagcaaagtccattgtaaccttgtcttctcccacatgccggaatcttctgtatgccatgttgtatttcatttgtccaaacacagcttctggttctatacacctcctgcctctatgcttgataccttcttctgagagcaacctttcccgtgcctgccgtttgtattgatttaatcggtggttgacttctataatacggttcccccgagctttaaaacaactgccacgcaaagggcaaccttcgcatctttttgctttataccgggcactttcggtgatgtatccgctcgctgtcttgtcacgtttggttcctatacggttcatgtgctgtcccataggacaaacgtaataatcctcttgggcattgtaatggagactttcggcatggaacgggttgggagtataacggggacgctgttctttatggaagtaattgtacttgatgaaggcttctatcccattctcctgcatgaaccggtaattttcttccgaaccgtaaccggagtctgccacgcagatattcggtaaacggttatagcggtactggaaagagtggaaaaaaggtatgagggtcagtgtatcggtagggttgggaaacagacggaagtctgtgataaattggttttcagtacctatttgcagattatatccgggtttggtctgcccgttcttcatggcatcttctttcatgcgcatgaatgtggcaccaggatcggtcttggaataggagttacgttctccaagggtatcaaggtgattgtcatattctatcagcttgtcacgatacccttcaagttccctgacctgcttcttctttttgcgcagggctttcttttcttccttatcctttgttgcaggctggcgttccagggcttctttaagttcatccactatgtcagagagcctgcaggaagtaaactccacggatgtgtcttttatagagttctcctgtgcaatggtttcatccacctgctccaagagaatacggattttatccattagtctcgtacggttccgttcgactgtcttgcgccagacaaaagcatatttgttggctttggattcaatcttggtgccgtcaatatactccacatcaaggctgatgaaacctttatcggcaaggacaaaaatcaactgggtaaatacattatttatttcctcctttacacggttacgaaaacggttgatcgtgataaaatccggatgctcattaccggcaagccaaatataatgaatgtcacgaaggaggtgcttctctattttacggcaagaatagatattattcatgtaggcgtagattatcaccttaagcatcattttaggatgataaggacaacggcccgtttccttataaagcttcttgaaactctcaagattgaggttgtcaataacagcattcacgatgcggaccgggtcgttcgcagctatgttttcatcaattctttgtggaaaaagaacggtttggttgggaatgtaaggacgaaaatgtaactttgccataacgaaaaactttatgcctaaagatacgaaaactttgggtaataacaaagcccgggcttgagaaagtctgggctttgcgcataaaaaaaggctgtgtcagcattttgacacaacctcttttttaattatatagtttttctgtttcatattctttgtctttttacagctaatggtttgacaaggagctgcatttagcagctaacttggcttgttatagatagttactttgccatatcacaaaaacaacttgttttgtgcactgttgcagcatttgattttaaggtgtttacacattcctcatattctttttctgtataaagaaccttatcttcaaaacctgctgtccaaattttctgaacgtcttcctgtaaatatggttttataatttgtgacatattgctttttagtgttgtcactattttcttgacctcaaacactttttcatctaaccagtcatgttcaggcaaatgtgcaggacttgctatgatgaattgaattttgtctggcatcacagaaaagcaatccagtttattaccataggtcagcggtacaaaacaatgcctcaagtcttttataagttgcagtaagatactattgtctgtttctgcattatataatatcggtttctttttgttagtattgatagttatacaatgacatcttccacttgaaaataaatagccatataaaccgacggaatttatttccggggcttctttaaggggaatacctttttcatataatggaagcaacgacaaataaagagtgtaatcggaaaagcgttcaccatatatatgagccatatccaaaggagataatccacgttcatcaactattgatatatccgcccctgatttgattaataaaaatacgcagtcaatacaattatatccacaagctgttaataaagcttgccccataatttgggctttattttctgctaattcatctataatcaattttgatatttctaattgtctcattatggcatctttcccatattgctgtcggttaacggtccattttaatagagatgctgcatcatagttgatttttgctcctctcttttgtagccacttaaataatgagacatcacaatttccacaagccggaaagtagagcttataccaatcttcatccgttaacggagaaacggaatttactgtttcaatatacctgatttgttcatctaagtttgaacaatgtcctatatattgctgcaacttatttcgttctttagcattcatattttatctataatgttttgacaagaagctgcgtttagcagctaacttggcttgttatcagtgatttattcagcaatacctgcacaggtaaattttaatccagtaattgaattttgtttcacaaaatctataaattcatctgtacaataataaccatcatcaaatatactatctcgaaatatgatatatggtccgatattttttttattaaagacacagttattttctctcaccatcatcaagatttcttcattgcttttagactctgtatttaaggattttattgtatttagtacatttataaaataatattctgaagtgtttccaaccacattgactggtaaaacttctatctggtctttcagcttttcagagagcaataaagaggttcttttatttactatcagatgacctgaaaaaaaacaagaagcatcaaagtcttcacttcgcttgtctttcttttttcttttatctctaaataattctaagttaagacctttccatccactaatgagtgattgacctctaaaatcccatatacctttattcaattcatcattttccttgaatacgaagaacttataattatcaaagtcttgtccaattttatatattttcataatgtcatactatttaattactgataatggttcagcagggaacggcttgtccgttatcctgcgttgttagcattattttaaccggcaccgttgaccatgcggttctgggcgtttcggtgaccacgaaggctgttgccgttgatggttctaacgttgcgggcgcctcggttgaggagttgacgcgtggcggtgccgccgctcaggccgggttgcaggcaggggacgtgatcaccgccgtttatggagagccggtgtcctcgtcgaagcagttgaccgggtacattcgtcgctaccgtagcggtcaggaagtaacgatcacctatgtccgcaatggtgagaagcgggatgtgaccgtcacgctcggcaaggcgtcctgatagctctgctaattcgaactctcggtgggctcaccctttgggtgggcccacctgtgtgtatgtgcatgtctcggtttgcgcttggtacgaacagttattccaaaagatggggttatacgacataatgtgtggcatttttggtggcttttcgttgttttggtgcgggaaagtctgtgttgaggttggtgtggggcaacttggaggttggataaaatgtgtggcgttgagggttgtttttcgttgctgtggtgcggaaaagtcgggttttaagttgatgtgtttgcttgggagatatgaaagctcctgtttgccttgtgtgcgtccagtcaatgaatcgcaatggaagaacgtctgctggacgagttaggtggaggtgtcgggggtgtaattcctcgatggtgcaacgtatcgactcgggagcaaagacttatcagcgttccttaactggctgttgtcagggacaactctcaaagagcttcccggtgagggcagatccttccagaggcgttgccaggcgttgtggagctattgggctttgccactcgtcattgatcaggtccatgacgtcatctacgttgatggcatccatctagggcgtaaagctgttgttctgattgctcgaagtgatgagtatgtgttgggctggtatgcggcaagagcggagaagcaagcgcgtgggaagcgttaatgagccgtatcgccccgcccttgttggtggtcactgatggggggaagcgggtttgagaaggcgcgcaagaacatctggcccactaccgtggtgcggcggtgtagggggtgtcaaatagtttgtgtaagccgtgttggaaggaaggggtataatcatgactatgttcgttgagtctttgctgggtcggtctttgggttaggacttggttgaccagctcaaagctttggggcagcttgatgtcttgttcgttcagattgatgcgggggaggtggggctgactggtgatggtggtttcgtgcctgccctggttaaagtagctcttgaacgtggtctgcaagcggagctgacgagccagttggggtacgagaaaggcgcagtagacgcggcagcgcacacgaactcgcgtaacggcacgacctcgaaaacggtccatagcgaagtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcagcggcggttgggcggcctggatgacatgattatcagcctttaggcgggcgggatgacgatcagggatatccaacaccacctggcttcgacgatcgggacggacctgtctcatgagacgatctcgaacattaccgatgctgtcagcgaggaggttggcctggcaggcccggcccctcgaagagttttatcccgtggtctacctcgacgcgatccgggatttctttccgtcgatgctgatccggcagaggacggcggtcgtgccgtccgatttcaccttgttacggttgatgtagaataagagcttgaatgtactgcgcatgataatgattgtttagggattaaaggataagtttcaaatcgcgggttgcctcgacgaacctgtccatgtcctcgaacagcttcttcggggttacgcgcgcgtatatctgggtggtctttatgttggagtgtcccagcattttgcagatggtctctatcggcactccctcctcgagcgtgaccagcgaggcgaaagaatgccgtcccatgtggtagacaaggtcctggctcagccctgccatcaggcgcagggatttcatattggccctgagcgtgtggtagtcctgcggcgggaaaagagtttcgcgggtatcgtcccggtatttctcaatcaacgcgacggcttccggaagcagcttgacacgtccgaggtagtcggttttctttcgctggtatttcagccagaggctgccctcgtcatcccggaagaggttcttccgggtgatgcttaccgcatcggcataggcggtgccggtgtaacaggcgaagaggaagaggtcccgggtgatgacatgtgacctgcgtttttccggtatctccagatcacgcagcttctcgaaattctcacggctgagtgctttcggtgttgtctccttctgcttgggcagcttgaagtggcagaaatggtatttctccgagtggccctccttgtaggcgatgcggcagatctttttcaagatggccaggtagccgcgaagcgtgtccacggcatatcccttttccagaaggatgaaatcctgatagtcgcggatgaactgctcgttgagctgcccgaagacaaggtccggaaccttgaatttcgccttgatgaattcggaaagcgtgcggtaggtgaagaggtaggtcgagagtgtggtgggcgcacggtccacaccgacacgggccttcatttccccgttatgccggtcgagaagtttgagcagggtcatctgcatgcccgcattgccctggaacatgtccctgaccgcggcggcatcaaaatccctttttctttccatgagggaattgaaggccgagtgtacggcaagcagcagtctttctattttttcattggtctccaccgcttcccggctcttgccgttcagccggctctcacgcgcgttccacagcccgggggtgcaggagagcttgcagctgaactgcgccatcgtgcggttgagggtgatccgtcccatgatcggggctttgccggtcttgtccggctcgctctttttcaggtagagcagcaccttgaatttttccactttcataacgctcttttttaggttgtaaaaatactcctttgaaaagcgtcctttggcatgcaaaacattgagaaacagtgaatacaaatccgctttgttcttatcggtaaaaattcggttacctgccgtcgtttccgaaacaggcggctaacagtctggtaactgaaacgtcgcaatattttgttttcttttgcaggtctgtctgttctgcaattctcgcaaaatgcttaattataaacgttttacgtttaattctcgtcattctgttttttattgcatttctaaatattacttatgccgcgagacatacttgggccaccatggcttaccactgcgagatacatccctcttattcaacagcctaaccaaaaagggtattctaatgaccctcaaaagtacaagaatgatagagaaagtaaagttatcagaagtggcaaccggcaatccggtatcacttattgggttggcatccggtcaaagcttggcgcaaatgcctatagaccgtttgccaaagactgagtatatcgctatggcatcgggaacggacaaattacgatatacacaattaaggtatagtactacttcaggggcaggaagcaggattcttttgattgtccccatttccggactgactgataaaatggatgcagccggagcctttggtagcctatatgtgttaagagccggaatgagctacatgcctatgatggtaaaagctgatataatgctgttccgttcctcttcattccttgttaatgatatgaatgtaatgggagcaagtgccgatggtcctgtaaacttcaaattgggacattgtacttatgaagggcagttatatcttgcggttaaattcaatacggaattttctataacaacttgctttcaaggattctacacgtcagattgtgtattccgtaacgttcttgaagagaatgttacggactggacagacttactatgaaataagcggaggaaattcttttagccgtattaataatctgtagaaatgctcagtaacttttacttttattgtgctcattgctgtctattgcttatttccgtcatatcctttgaccctcaaaagtacaaaggtatgatagaaaaggttaatataacagatgccaatgtggttgagttaattagagaaaaactgcctgctgcaacagaagcaaacaagggacttatgcaagctaatggatttgaacaaggtaagaatatattaaatgaagaatacgatagtaaaatcagtgctggtgtatattcatctactgataatttaaataatatgggcactggaattttattagcgctaagagggtttcaatacacagcccatttatatattactaactctgcaaaaatatatattaaaaccattcgtagcaatggagaggttttgaaagattggacgttaataaataataccataacataagagacttttggagtatccattttcctaccctatcctttgaccctcaaaagtacaaaggatatgatagagaaggtaaacataagtcaagtaatgaaccagtatcagatagtaactgatgcagactatgtgtgtgtggaaaaagggaatagccaggggaagatcaataagggtgatttgcttaatgcaatgtttcaaaaaggaacacccgtaaaagattacaacttaaatacagaaattggtatatactacataaacgttagcgttaatggcaccatcaacggaccatccaattcaattagctatggtattctttttgtacttaaaggattaaataattatattgttcaaatagcatgtagtgttactggccttctaaatgtattcataaggacaagaactgaacttgcttggagtgaatggaaatcagtaaatattacctaatatgacggtataatttgctccttttatttcttatcgaatcttctgaccctcaaaagtacaagggatatgatagagaaagttaacataacagattccaattgaatgcccacgtggcggcgatcctcaagaagcgccaccgtgtgcttgccaaggtgacgaaaaagcccacgagccgtaaagtggagatggcgggccagacggttgacgtgaacaatccggacggcgagatgacctattgtccgttggatgataccagcagtaataaatactacgatggcagcgcagccaaacttgacagcagcgagggcgactggatgatgtacgaaccgttcttttggtcgaaaggtgtcaatgactacctgaacgagaaatattacagctgttacagttccaacggccctgacgatatgcctcctgttccggatgtgacggtgctgacgttggacgacatcaaagacacgcagggcggtttccttacagagcgcaaacttttgagtggcaaacccacgttgaaggattcttatagcacggacaagacctattcagtctgcaaggtggatgtacaaggctataagcgtgtacgttttccgagtgttcccggtacgggtttggtcggcagtctatttgttgacggctccagaaacgtggtcaaaaccatcgtggtccctacgatcggtctgaagttcgaggccggcatgtacttgatatcggatgttccggaggacgccacggccttgcacttctcgatcctgaacacggccgagtttgacaaggtggttctttccaactccgacaagatcgaggatatggagcccgattgggtggccaacgaggaacatctttgtgcggtagtaggcagtagcgtggtaggtagcaagttgcgttcatgcataacgggtaattccacgacggccagcatgaactggatcgactttcattattactcggttcagcgcggtatgcaacagatagacgcgttgatgcactcccgtatagcgaacttgttttacgcaagatatggccgtcgtgacagccaggaacagtgcggaggcggtcagcatacgaacaatcgtatcacgggcggtacagccggttatggtatgcaggatacgatcggttatgacgaagcgtataaaataaacgacaagatcacgaattccatcgtggacggttctatccaccagtacgcttggtatcgtgggcaggacgagtatggttctccgaccgtgactcaggtaaacaatatcagttgtctgggctatgaggacatctacggccataagtacgagatgatggacggtgttgatttacccaacgatagtggcaaccaaggtaaatggcgtatttggatgccggacggcacggtgcgttgggtgaagggtaaaacgaccagtgaccagtggataacaggtgttgctcatggtaaatacatggatatcgtaccggtaggaacagctaacggctcgtccagtacatattattgcgataaatactggataagtaccgcagccagccgtgcggtctatcgcgggtgcagcaatgcgtttgcgaatggcggcgtgtcggttgcgtatgcgagttacgatgcatcgtactcgggcgcgggtgtcggctcccgtctggccttccgcggcaaactcgttcgggcggaaagcgtggaagcgtataaaggtgacacgccggcgtcggagttcgccttgacgccttccgagatacccttgacctgcgcgcctacgccggtctttaggtttgcacttacgctgtcgaaatatcctacgtccgccataatatattttattcccagaatttatcaaactggatataattaccgaaccaaaacttaaatgcttctcggtttataccatccgaaggtgtccaaaaatcaacaggatattcccagtctgaattgtgtgactttttaggagcaagccctaagtttacatactcatggaatggacttttgtgttgtgccgtctccaatattccgcaaaagcccaatgtttgtagaagacattgggtctgagttttatttgtatcaaataattgaatcttattaattcttttgacgatatccttttttaatgtttcttgagatgaggcatctacaaggctcatcataatttcattaaaaatatgagcatcagtacagcttggctctattgcattatttgccaatttattaaactcagtcagtagtacaatgcaaaattcaagactaaaagctggaattcctccagcattggaagctatctctaaataaaaattataatcttcattttcaaatccagcccatgaatctatattgcagattttacaaggatcatcacgaaatctattaacttcattagaactgacaaagtgatgtcttgggaatgtacgcgttattgcgaatgctggtaaaaaacttcgccataacatattaccagtagaaaggcttgacaaaaaaaatgaaactattttattttttttgttaatacatttatcatactggataaacagttcttcaatcattttgtcatgaaggcaagtatattgttgattcataaaatgtaatttttaaccgtaactattctttttagtagctctatattcctcaaatgttttcctttctccatttgcgatgcgatcagaaagagacatttttttaagttttttctctgcactacgcatgtacaatttgcccttctcactatttttatccctaattccgtttattttatttcctcggacattgtcacttcgatatcctaacaacgatactgaagaattatctataccaacttgttctattcctctcactatcaatctatctgtacctttttttgttatttgtacaatagtatcaccttcaccgaaccttggtccatcagttccctttgttcctgcatgccttcttgccacatcatttatgttagcattatctgatgctcttccagaataatacacctcacctttagaattaataagaacatagttccaatcaagtccatataaatctataatcaagttcgtgtcgctgacgtagccatacaggttgagtattccgccagccagtccaatcggatcttgcgagacatacatgcccatcttcggcgagtagtacctgaacctgttgtatgccagtcctgtctcacagtcataatactgtccctggaacaggaacggtaccattcccttgttccccgtttcctcgatgacgttcccgtccatgtcgagcacccggctccacacctcgtttttccgttacttcgcaggtaacggaggaattttccgtgcaaacataatcgtttttctataaatgagcaaataataatgctgtttttttataattaatcgaaaaatctgcatttaagcgcacttttttgttaatggaattgttgttgccccagctattagcgtatttgtacgtgtgttctgtattacagaggagttacccttatacatattataaataagaaatgtataattaaaattgaagatgaaagagattaccttacaagaaatgctgtcaactattattggagagcttcggaaaaatggaagatggggaacagcccatatttaccaatccacattgaatgtgttttccgtattcaacaactatcagaatttgcatctgcgcaaactgaattcagtggttttaaaacgttttgaaatgtacctgcgccaacgggattgtagttggaataccgtttccacctatatgaaagtcatccgttcggcttataaccgagctgtagatttacgatatgtccgttatattcccaggttgtttgaacatgtgtatacgggaactaaagcggacaagaaaagagcattggaagcttcggatataggagctttagtttgcgagacagagatggatttgtccaaaaggattccctcctcgagacttcaaaaagcaaaaatgctattcgtgtttatgtttatgatgcgtggtcttccgtttgtcgatttggcttttttgcgtaagaaagacttgcaaggtaacgtattatcctatcgtagaagaaaaactggtcacaccttgcgggtacttctgtcccctgaagccttgcagttggtacgcatggtgtccaataaggacgaaaactcaccttatttatttccaatattacatagcaaggagggtaccgaagcggcttataaagagtatcaatcagctctgagacgttttaactatcagttatcaactttaaaaacacatttaaacatgagttcacatcttagctcgtattcggcaagacacacatgggctacaatggcatattattgcgagattcaccctggaattatttctgaagcgatgggacactcatcgataaatgttactgaaacctatctcaaacccttcaacgacaagaagattgatgaggcaaatgagaaggtaatttcttttgtgaaaagcaatggaatttcggcatagtttttttgctttttattgatagaatagtctaaatatgtacttatttattcctcccgcaagagacttctcttgaagggaaggatcgccttgtttgtttctcagccaccttttcttatgtcaaagtactacaaaataagactttatattttcccctgtcttgcaaaccttttgagtctctttcacctcaatcttatttcttagtcctattataagaattccacctataagcccctccttatctttattcatttaaaatattataaacaattatagatgtatcgaaactgtattaaacatgtttttatacaattgattaaatatagattcccgttacctgcgaagtaacggaaaatggtatttgtaagcatcccggtaagcttccaccgattttgtccccttgcttgccttgatggtatcggtcaggtcctcaatggaggtctgcagtttctcgttccggtctgtaaggcggtctatagccgcctgcacttccctggcgtttccgccgatgccgaacagtttgttgaaacctccgaaagacaccgtgttcagcaatcccccgatacctttcacaagggaaccgcctatctgtttgaacaggtctccgctgaggatattgtcgagtattccggttatcgcattgaaaatggtgtctatcaatgatgagataatcgggccaataccgtctttcagcaaatccagtatggagagaatggccgatatgatctgcccgatgactccggcacttgacagggtctcggacatccggctgatggcatcaccgaccttgcctccgatattcagttttgacagaccggtaagcatattctggattccttcaaatgatccctgcaaggttccgctcgcaaagccgtgcaatccgttggataccatgttcaacccgtcaaccgtgtcccgggaggcacttttcacctccccggcaagcgccttcatttcagaggtggcgttcaggtattcctcgtcagctgaagcactggacgattgggccgtttgaagagcgattttggtacgttctatttctgcctggttaccgctttcaagagccttgttgtaatcggtctgcgccgcttttaaccgggcgaatgccgcttcctgctgcagttccgcattttgcacacgtgttacggcatcccccaaagcgtgcatctgcgtttgcagccgggcaaaatccaatgtgccgttaccaccggggagcatgctttgaatacgttcaatggcatcgtagacgacctgctggtctgcggctcccgtttttttgaactcatccgtcttgacatactgtttaagctcgccaagcaggttcttcatctggtctgcaagcaggcctgtcaaatccccgaacgctgctccccagtctatcttttgggtcagagcttccatatccactttatgcacagccgcatcacgctgtttctccaaagtcagcctttcaccctgggactgtgccttgcggattttctcggcatattcttcagcgatggccagtttctgttgctggaaggtcccgtattccttcagatagtcacgcatggcttccgcctcttccctgtacacgtccgcctccgcttttttccgggacgcggtgtttgaggcacgggctttttcaagttcatcctgttgctcccgggtaagtccgttatctccggtggaaagaccggcttccttgttctcacgcttccagtcggcttcctgccggtttatctcttctttccgggcgttatagtcatattcgatttgtgccagtttcttttcggtaccggcttgcatacggtctatctcttccttccggttctcggcctgcagggcggcaagatcctgcgccagcctgcgaagatgaacaaaacatcttgaacgtcacccaatttttgcctccgtcagtctcaggttttaaccccctccgccacttcaagaaaacaggactggctttgtccggctaaccattaacaaacaacacagattgaagtacaatgtactaaaaggcgttgggagacggtaaacatggctttttcaatcagacttagcgagaaagaacgcaagctagccacaagctattcgcacttgcacgggatttctttaggtgaagcattcaagcaagcactgttcgaacgtatcgaggacgaatacgacgtacagatagcccaagaagcactcaacgagtgggcacgagacggatataaaactcgccctattgaagaattatgggaagagtgcgggctgtgaactggcgtttagaaacatccaaagcattcgataaagaatttaaaaagctcgaccactacactcaacgaatcatcaaaggctggattactaaaaacctcatggaagccgacaacccgcgcattcacggcaaagccttaacaggcaatctcgctggcttatggcgctatcgcatcggcgactatcgactcatcgccgaaatcaaagacgacaagctttctatcttggctatctccatcgggcacagacgcgagatataccgctaagcaaaaacggctaggaaacttcctagcctctttaatttttctacctcactccgcgtccactgctgcactgcggactgggatcatccccgcgtgcgcgggggtttaggaacgccgaacgagcactactcttgcttgagcgttcacctcattcacaccctgaaaatgacctatccatgacctatagcaatgacataggtcaacctacgccaaaacctgcagcagaactgcaccagcccagctcagaggctattcatacgcctatagcaatgacctatagcaaacctcgtcataacatacgtcaaaagctcatcaactggctatccacataaacacccgtatattgaagtgtcctgtgttttgttcctaggcatttgtcttgatttgtattgtttcctgtggcggggtctgcttccaaaattcggtttcgatcttagccggggttcggtgtcctaatgctttggtggagtctagtctcgttccgctatgacaccgacttgaacgttgcgatttctaccttgataacgtcatcccacctgcgagcatggatcagctcgttcttgtaggagccgttaacgttttcggcagccaaatcttcaggcacaggttctgggatgtttcccgcacggcgggcctgctaagtccactgacaagctgtgcgccacgcccccagctttgaggctaccgcctagcacacgacttgcatcgacatgttctccgccaagatacgctcttccacaagacgaaccacacgaaaccgcgagagtaacgaaatccgggacagtgtcaggcgggcagtttgactggggcggtcgcctccgaaagagtaacggaggcgcccaaaggttccctcagcgcggccggaaatcgcgcgaagagtgtaaaggcagaagggagcttgactgcgagtcaaacacgacgagcaggtacgaaagtagggcttagtgatccggtggtaccgagtggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctggggctgaagtcggtcccaagggttgggctgttcgcccattaaagtggtacgtgagctgggttcagaacgtcgtgagacagttcggtccctatccatcgcgggcgcaagagatttgaagggggctgctcctagtacgagaggaccggagtggacgaaccgctggtgtaccaattatcccgccaggggtacagttgggtagctacgttcggaaaggataaacgctgaaagcatctaagcgtgaaaccagccttaagatgagatctctcatagagcaatctagtaagacaccttaaagaagatgaggttgataggtcgggagtgtaagtacagcaatgtattgagcggaccgatactaatatgtcgagggcttgacttaagtgacgccctgacagaggcaagcgcaagcgaagccaatggcaggaaaggttgaacttatatcgaaaaagcgacctgaggggagcgttttcgatgaaagtgaatcgccgaaaagaagtaaaaacacacagcgaactcaaaagtttgtactcttctatatagttttgaaggcttaaagaccttctgaaacaatccggtggcgatagctaaggggacccacctgttctcatcccgaacacagtagttaagcccttaaacgtcgaaagtacttggctggaagcggcctgggaggatagaaagctgccggttaaaaaataaccataccatacggtatggttatttttttatgttaggtaaatacaatccggccagaccttgccctgggacacatggcaggcaaaagcggaagttgcatgcctgtgtactggaaaactgtctgttttaaaataagcattatatatctttacactttaggtataccatatggaactgactgaagtcacgaaatttcgccgggcagtattaaccggtttagcacgctttacctggcaagggactttaccagagcatatttatgatatactttatagcgttgtaacagaagacagtcctcgtgttcgttgctgtgtgcataaggaacgggctgtactgaaaaatcgcatcaatatggcactggggcttacggttggattgatgcaaaggtaagaacttttaagtatatcctccaaatattttcggaagttttttttctttttttctctcttttctctttcctcgtcgtctctcttgtcgaaagggaggcaaaaagaaaaaggaagaagaaccaggcaccgtttcttttaaaagaatgtcaactcgcgctgctttcattttcaaaagcgggtgcaaaggtaagaactttaaagcataacttccaaatattttcagaagttttttttcatttttcttttccaaggccgaagttccggaagaaaccgatggcaaagaagagaaaaatggaagcttaccgctccgttttactgtcagaatgtcaaaacatcgccgccttcgttcccgaaagcggatgcaaaagtaggccttttatggacatctgcaaaatttatacacggtttttttgagagattccatgaactttttcataactcactgattgatagatatgttttaaagcatgttttttaaaggaaactgggataaggaaaggaagggacacattatatatatacgcgcgcgcaatacaagctccaattcataccttgacatagaccactgaacgacaggcaccgcgcttgcgaatcacgccggaatcgataaatgtctgcaaatccctcgaagcccggcgggcggtgacgtggacaaggcgggaatattctgcacgagtgatacagatattagcctccagaaagtccatcatgcttttttcacgggcagccatgtcgcccattgctttcggtttatccggaaagaagcgtttatccgcacgttccaactccatcttacctgccacataacgtttgaattcgatgctgggacggaatttcaccgtggacatcttgaccgactccgcacgtacttctttcttattcatcaccggatgggtacacttcagcgtggtgctgaagaagccaagtccctctatctccaccgtatagccctttgccagccagtctccaagcgtagtggtgatagcttgcacaatacccacaaccatggcgtggggcatatgttcttcacgaaaaacccgttccatgaactctttaccggaaatggttcccttggaacagacacgggcatgtagcgacttcggttcctcgccttcggggacgggcgtttcataaaggtcataataagcactcataaaataatttaaattaatggtttatagagaattgagggaaacttgcagcaaacttggggaagaaatgttctcgaaatcggcagaagctggcagtaaaggtactaattatttttcttgccacaaggattttactttctttccactgccgtattcttttctttccacagctgtggaaagaaaagaatacggcagtgagatcgaagcaaagcatattactgacggtgaaaatggtttgaccgttctcgaacgcgtctacaaagcagacgacgttaaagatggaaaagtgaatgatggagtgcagcctgtagcgtcgcatgtcgatgctaaagatgatatgcagacggtagttgtcgataaggttgctaagagctacgtctacgacttccaaaaagtagaccaagacggtaaaccgttgacgggcgctcgcctgaaagttacgtacgagaacggtagggacgttccgcgtatgggctggaacacgctcactgttcctactcccgtcacgctcgaagcaggcacctatattctcacagaagtaacagtgcctcaaggttatgagaaactagctgacactaagttcactgttaaagaagatggaactattgatttcaacggttctacagctattacnnnnnnnnnnttgtgaaagtcacgaacacgaaaaaaccagatccgttcgtgaatccaacaggcacgctcgcgacaaccgtcaccgccagtggcaaagctgcggctaaagaccagccagtcactctcactgccgatcaggtcaaaaacaatgtgactgtgaccgatacgatcacctacaacggtttcgtcaaaggtgaacaatataaggtaactggcacattaaataagatcaccgataatggcaccaaggcagaagccgtannnnnnnnnnnnnnnnnnnnnnnnnnnnnnnnnnnnnnnnnnnnnnnnnnatcgggtaacgagattgcgtttaagggtgaggataagccttctcagcatgtggtgacgcatgaggataagggtgataaggctcagacggttgttgtgtcgaagcctgatgtgcctgcgcctggtcctgggcctgatcctgaggttcctggtgttgataggccggtggattcgtcgttgaagacgacggtgtcggttgatggtaaggctgcttcggaatctgctccgttgtcgttggtggttgatggtaagactgctaagactgttgttgatacggtggattatgcgggtcttgttgttggtcagtcgtatacgttgtctggtcgtttgatgaagcttggtgagggtgtggatcctcagcaggtggctgaggcgtcggtgacgtttactccgacaaatccggcaggtaggcagacggtgacgtttgagaatgtgatggtggagcctggggtgtcgtatgtcgtgtttgagactgcgacgtcggataacgagattgcgtttaagggtgaggataagccgtctcagcatgtggtgacgcatgaggataagggtgataatgtaatagtcaagacttgttctgacatttgttttactatcggacaaaaaaactgtcagatgtttgttgcgaagttacacaagtttcatcatcctcacaaccgaatgagattttatcctgctcattcggttttatcatttcctgattttgcagttgatactttcttgccacagcgattccttcgataaaagtttgcatgggcgttttcccgaaacagtactttccagagtgtgttctttgggtattgtaggagttcatccacatatcaaggtctgcttgcagctgttcgatagaggtatagattttctttctgaatgcaatagcatagaactcattctgcacggttctgttaaatcgctcacatataccgtttgtctgagggcttttcgccttaatcttagaatgatcaatgtcttccacagccaaatacaattcatactcatgattttctctgtttccgcagtattctgttcctctatctgttagcatacgcatcagtttcaagtcatgctgctcgaaaaaaggaataaccctatcgttaagcatatcggcagcaacaagcgcattctttctgtcatacaacttggcaaatccgattttggagtaagtatcaatgacggtctgctgataaatgtgtcccacacctttgatatatcctacataataagtgtcttgggcaagtagaaaaccgggataataagtttctatctctccatgagcctgcttttcttcttttgctttttccaatgccgccacttggttctcatcaaggataatgccctcttgttccactttggctgacaatgctttcaggcgtttctggaaggtctccatatcgtgccgtagccaaatggaacgcactccgcccggcgaaataagaatacctttcttacgtagctcattggatacacggacttgccccaatgcaggattgtctatcgccatctgtacgactgcctgctcgatgtgttcttccacacggttctttatgacaggcttacggcgagaaatctcctgcaaggcgacttcaccgccttgttcatacaactctttgaaacgataaaaactgtcacgactgtagcccataaccttacaagcacgtgatacgtttcctaactgttgggagagttcaagcaatcccagtttgttcttgatgaccttttctgatgttgtcataacttaatctgttttctgttacaaatttattctttttatacgtaactgtcagattaagtcttgactaattcattacctgcgaagtaacggaaaattttaacaaaaaaataagagaaagtaataccaaatatgcgagattattcactttttattttttaaaatttataaatttaaagttttcaattataaacataagtatgttcttgttcagtgtcttaatggccggtactgcaggaactttcacgtcttgtaaggactatgatgacgacatcgaaagcttggataatcgcgtatcagcagtagaaaagctggtaagtgaccttcaagctaagattgacgcggagtcggtcattaccggcgttgacaaaacagaagatggcattgtcatcaaattaagcaatggcgattcttattttatcaagaatggaacaaacggcacaaatgctcctgtctggagtattgtaaaagaggctaaaaccatctattactatccaggtactgaagagactggtaagttgcatggccaagcagaagctgactactgggtgaaagtaacagaagagaagggtaaagatcctttatatgaagtacaaactacgaaatggttaccggaaggaacactttcagcagtttggaatacaaaagatgaaactctgacccttggtaacatgaaggatgagaactgtagcttatgtaatcaagaaaggtacaagtgctaccaattggattactttgaaagatgccactaagaaaacttattggatgccttcaaccagcgcaatgtactatcacttgaacccgctgaatgccaagctgaaagatattgagtggaaattcttggcagctactcctgctgtggtaacccctatcttccaaaacgctggtaagaccattgacggcgaaaaaatgtatgctacatacaaactctctgtagaggatttgaagaagggcaatttgagcactctcggtgaaaacaactatatttctatcgcagctctggaagcaacattgattaatggcgaaaaagaaggtgaagaaaagtctacagttacttctgactatgcagccatcatgccgatgattcaaggctttaaagccattgcgtataccgatgacagcaaaatcgtaacaaaaagcacttgtaagcctgaactgtataagacagctaaggaagctatcgaaaacgtatatactgttcctgcacaatacaatggtaaccattctattttccgccttgacataagttgttagccgacatatctttgcgcgtgacacgccggcgtcggagttcgccttgacgccttccgagatacccttgacctgcgcgcctacgccggtctttaggttagcactcacgctgtcgaaataacctgtgtccgccataactatgtgcttgcattaagctgttaccattcggaacatctaaatttatcaaaagtctttaaattcatcgttttccataaaaaagattaaggcttctatataatctttttctgatggtatgccaatttgatccattacatttaataatatatcttcaaattgttcgccataatacaataattccaaattttctttctgtacaaaatcgggataaacttcttcatcatttttaatttcaggatatttatcaatgaagcatagttgatcccactgtatattttcacttttagaatatatacaataattctcatttgagaatccatgtacctgtatctgctgggatacttgtttgattataaaacctaaagtataaggcttttctgattttaaattatccatatatttattattttttttgtttataacctgtggaaccatttaatcgtcctttacgaccatcattaccaccaccccataaatctcgcccacctttacctgatggatgataaagtttatgattgagtgaatgatctcttctgtccaccaagaccagtctccttgtttcttcatgatgatgccatgtaaaaccagacgggcttgatgtcatgtttggatttttaatccatgcatgtagttctggatgcctttttaacatatcatgcttaaagattgcatcagaattgattttatttagaaattcttgatttgctctattaaattggacagcatcacttgcgtattggtctttcgcattcactgtatgctcaaaaaagatgtgatactttccattattggggcgtgtagctaaaccaagaacatcactccacgcatttgtatcatcgacatacccatataaattgagtattccaccaccaagtccaatcgggtcttgcgagacgtacatccccatcttcgggtcatagtacctgaacctgttatatgccagccctgtctcccgatcataatactgtccctggaacaggaacggtaccattcccttgttgcccgtttcctcgatgacgttcccgtccatgtcgagtacccggctccacacctcgtaaaaatacagctaacaacgcaggataacggtaaaccgttccctgctgaaccattagtaccaacattaaaattaccaatcatgagtaaagagataaatgcccaaaaatacatcaaggaatacgaaagcgacaaagtggttgcccgtcatgtatttcctctcacattggaagattacatgaaagaccagacagagtgctatattaaatatctgtccccaaaagacatgccctatgacggataccgagaattgcgcataaaaccattaggagagaatccggcagagacaatctcgaaaagaatccgatactggacgtggcagattcagacgccttattattacctcttataccaagctttccaagaaggtgattggcgagctgtgaacgatgcgcaataccaatatgccaagcagcaattgtggcatgattataactattatgatattcgcaatgcttggctgcttatggctgctaacgatttctctttgctcgactgtaacgatgcttatggtttcagtgaagcattccacagagtatggacagcaccgggcaacatgatgatggggctttacctgcacgatgatgcagccattaaaagaggaatggcggaagcagaaaaattgttagggcagaaaaccgtaggcaaatggtataaagaattatcacgtttcatgctggcattggtcaatcgtgatatgacagaagccagccgcagcctgaacaccttgtgtgagaattacaggtattacgaccaagaattgttatcgtttgaaaaacttttctgcactccggctcatggtctttacaattttgcccgtcgggtgctgaccggaacagagttttcaaggcttgaaatgccgtcatccccaacctttttccgagagttcgccttatggcaacgggataataattaccctgccggaaagcaagcattggtctatcccgaccattcactccgtttcatgaacgaaatcatcaatctgccaccattgcccagcaatgctccctttgaggctcttgggcagaactggataaaaatatatggtcaagggattgtaaacttaggtactaacaaggaaagataacacctaaacggcgttcctttccaaaccattataaacaataaagccaatggatataaagaatgatatacatattatggaagagtgccaatatcgcgcagatccatgcactggagaagcagcttgaggaattgcgcggcaaactgaaactgctgcaggaggaatcggaatccgtgcaggtcacccctgcagacatgcccaatgcacagcgccagttcaacgggcttcacaacagcatccagcagatggcccgtgaaatgccttctttggccatgggaccgcagatgttctttctggccatatccaacaacctgccgatttttacggacgaactggcccgtgcccgtaaggaatatgatgagctgcagaagtcaggcaagaaaggcacaccggtatggaaacaggtcctgtcctcgctcttttcctggcagacggccatgaccaccggcatcatgctgctggtaatgtacggtgatgaaatctgggattggacgaaaaacctgttcagtgccaaaaaaggcgtggatgaattcaacgtatcagtcaaggaaatgaccgagatagagaaggacggccgtgcccagatggtgcgtacccgcttcgaactgaaatcggtcatcgatgaaataaagaacttcaccggcagcaaggaacaggaaaaggcgaaggtagaggaactgaaccgcaagtacggggaatctttcgggtattataaaacactttccgaatggtatgatacccttatccaaaagagcgaggactatgtacaggtcctgctgcaccaggccaatgtccagaaccttgtaaaaaaagctgcagaagccgatgaagaggtgaataaaatcaaggcgcagaaaccggaagaggcggaaagcgccatgggttttttcgggaaatggggacaatatatcatgcagtcaagcatggcagaatccgggcagttctatgatgcacaggctgccattaagaaacatgatcaggaagcttatgacatactgttgaaaaatgccgaaaacaaacgcgacggttatctgaaaaaagcggaggaagaggtaaagaaagcggcagaagcagccaaaaaaggaaatatcggcggacataccgaccccgaacagtccgggaagaatcaggaagcggaagccaagcaacggcttgccacagagcgcaggctggcgcaggatcttgccgccctgcaggccgagaaccggaaggaagagaagagtgccaatatcgcgcagatccatgcactggagaagcagcttgaggaattgcgaagccagttgaaactgctgcaggaggaatcggaatccgtgcaggttacccctgcagatgtacccaacgcacagcgccagttcaatggtctgcacaacagtatccagcagatagcccgtgagatgccttcactggccatgggaccgcagatgttcttcctggccatatccaacaacctgccgatttttacggacgaactggcccgtgcccgcaaggaatacgatgagctgcagaagtccggtaagaaaggtacaccggtatggaagcaggttctgtcctcactcttttcctggcagacagccatgaccaccggtatcatgctgctggtgatgtacggtgacgaaatatgggattggacgaaaaaactgttcagtgccaagaaaggcgtagacgagtttaacatctcgctgaaggaaatgaccgagatagagaaagacggccgtgcccagatggtgcgtacccgtttcgaacttaaatcggttatcgatgagataaagaacttcgtcggaagcaaggaacaggaaaaggcgaaggtggaggaactgaaccgcaagtacggggaatctttcggatattataaaacactttctgaatggtatgataccattatccaaaagagtgatgattatgtacaatccctcttcctccaagcgaaagtacagaatttagtaaaaaaagcgtcagaggttgatgaaaaaatagccgaggcagaagcgaaggatgagagtgaatttgatacttggtggggatatggaggaaaggttgaccgtttcttttcttcggatcaatcatataaacagaataataacggacgttggaaaaaaaaggaagaaatagagcggcttaaatcagaatataacggatatatattagcagcggagaatttaaccaaggaacgcttgaaactggaacagaagtcaggcatcggcgggcataccgaccccaaacagcccggaaagaatccggaagcggaagccaagcaacggcttgccacagaacgcaggctggcgcaggatcttgccgccctgcaggccgagaaccggaaggaagagatgaccctcaaaagtacaaaggtatgatggaaaagattaagttgtcagaagtggagagaggtttgcctaacggaataattgctcagatacgcgggctgaatacccagggagagggcattttagaaccgttggattcttttttgagtgacatattatgtgcaagaggctcctttatatataacagtcaagaagttatagataacctcaagaaacctggtgtgtataagcatggggaccccataatcggtacggggacttcctatggcgcacatggtgtgctcttggtcttgtatatagatgaatatacaatacatattgattttcctgcaaggaaaaactttatccttgtaagaaagtgtgtcactgccaacgggaaagatgagtggtcttcatggaaatatatatcgttaacagacatatcaacgtaacagacctacccgttttatccgagatggccggaacggataatctgtttctcacaaactaaacatccgtcaatggcgacaaagacaagaaacggaaataaatgctacagtggggggaattattcccccaccttagactcctccatgtagctcgcagcagtcacctcactctcgtcagccgcttccaatatgaattcaaatgttgtcggatggtaggaagacaatagtttcgcatatactccgggcgtgtaatccctacgctcaagaaataccttgaatgctccagtatcggtattatagagcttgaatttcggccttgcattttccgttcccaaaacaccgcctatcagatttaatttgtatgaaggagttgctgttaccccttcagacctatatattgaaaggaaatatagggcaaccggtcctcctccgtatgactgtacactaaatagaattccatcggagaaagaagatgtgtcctttctctcaaacaacaatatggaggatgtcatggatacccgcttttcttgtcgcatgtccctggcaggtttcaggccgttttttacctctgttgcaatgggtagcttctctctgattaactcaactacattggaatctgttatgttaactttctctatcatatcccttgtacttttgagggtcccgcaaaacgaaacgtttacgcaggtttaatttctgtttacgtggagggctgttttggttgcataggtttggcgattgctttaaatgagcttacatgaggtttacatggtgtgtaagtaggataggaagatagcggttatatgccgctttttttatgccttgttttggattatatgtttctaaaatattccatataatgattatttggtatatttgctccgcaaaatatattgatatggcaaaggttatacatgtgcatttgacgcacggaatagacggaacaaagcgaagagattggtattttagtagtatttcggctgtttatacggttttgacggcagaacaggtgggtgcgaccaagaattatttgttacatgccggtctgtccggtaatggtacagtatgcactaaaagggctataatcaagcaatctacgcttatttcagggagtaggaggggagagtaggtgaatagattagaatggcattagaacgaaagaaaatcaccattcagcagttattcttgtagaggagacttatggtctccttttttgtgtctcaaagtggcgagtgaagtgatgattgtcctaacacttggagtggcaattttggaggtggggatagtactgaggttagaaagtggggttagtttttataagaactggggttagtaaacacggttttgagagggggtagttggaagtatggtaaaatatggttttttgaatgataggtgtaaaatatgccttgatacacccaccctaaaaaccatcacctataaaaagtatacattattatataacggattatcagtccttttggggcgattatatggggtggatggagggggaataccgagagaggggagtctgaaggtataatcgggggtacccacagggtaacgtttcatgttctccggatggtaaaagtacgctctaccctacatttgcattcccagaagtgtacgcatccgatgcaggtttccctttttcaagattcatttggcgaatttgttctttgagacggccagttgctcttgaagctcatcattccaaatgttatcatttaggaatgggtaaaaatgtatcaaagtcatcgctggcaagagcaaatcaagatagagactatcacatctttgaagaatatgcttactacctagttagcgaagcacgacaaaagtgtgctaatcatattttcaaacttggcggtaacgtttatgctttcgattcgacaactattgacctgtgcctttcagtcttttggtgggcaaaattccgcaaaaagaaaggtggtattaaagtgcatacattatatgatgtggaaacacagattcctgcattctttcatatcacggaagcatccgtacacgattctaaagtcatgattgaaattccttatgaaccaagctcttattacatctttgaccgcggttatagcaacttcaaaatgctgtataaaattcatcaaattgaagcctactttgttgtcagagcaaaaagaatctcgggtacaaatccatccaatggaaacgtaggctgcctaagaatgtgctttcagacgcgagtgtacttctgacaggattctatcctaaacaatattacccagagccacttaggctggttaaatattgggatgaagaacaagaacgagaatttatattcataaccaatgcgatgcatatatctgcgcttcaagttgctgaactttataaaaatcgctggcaggtagagctgtttttcaaatggctcaagcagcaccttaaaatcaaaagattttggggaactacagagaatgctgttcgaatacagatatatgctgctatatgcgcttactgtttggtggcaatcattcaacacgatatgcaactggacagaagtacatatgaagtgttacaaatactgagcatctcattgactgataagacttatctgagagacctctttaataaaactaaatttcaaaatgacaaagaacgattcggaccaaatgggccaagtttgtttaatttttaattcgtcccaattttaatgggacactaatg
